US008563706B2

(12) United States Patent
Scheel et al.

(10) Patent No.: US 8,563,706 B2
(45) Date of Patent: Oct. 22, 2013

(54) EFFICIENT CELL CULTURE SYSTEM FOR HEPATITIS C VIRUS GENOTYPE 1A AND 1B

(75) Inventors: Troels Kasper Hoyer Scheel, Kobenhavn NV (DK); Judith M. Gottwein, Frederiksberg (DK); Jannick Prento, Bronshoj (DK); Tanja Bertelsen Jensen, Frederiksberg C (DK); Jens Bukh, Praesto (DK)

(73) Assignee: Hvidovre Hospital, Hvidovre (DK)

( * ) Notice: Subject to any disclaimer, the term of this patent is extended or adjusted under 35 U.S.C. 154(b) by 346 days.

(21) Appl. No.: 12/809,345

(22) PCT Filed: Dec. 19, 2008

(86) PCT No.: PCT/DK2008/050333
§ 371 (c)(1),
(2), (4) Date: Nov. 22, 2010

(87) PCT Pub. No.: WO2009/080053
PCT Pub. Date: Jul. 2, 2009

(65) Prior Publication Data
US 2011/0059513 A1    Mar. 10, 2011

(30) Foreign Application Priority Data

Dec. 20, 2007  (EP) .................................... 07123825
Aug. 15, 2008  (EP) .................................... 08162466
Oct. 1, 2008    (DK) ................................ 2008 01377

(51) Int. Cl.
*C07H 21/00*      (2006.01)
*A61K 39/12*      (2006.01)
*A61K 39/29*      (2006.01)
*A61K 39/295*     (2006.01)
*C12N 7/00*       (2006.01)

(52) U.S. Cl.
USPC .................. 536/23.72; 424/199.1; 424/202.1; 424/228.1; 435/235.1; 435/69.1

(58) Field of Classification Search
None
See application file for complete search history.

(56) References Cited

U.S. PATENT DOCUMENTS 5,428,145 A    6/1995  Okamoto et al.
7,674,612 B2   3/2010  Rice et al.
7,935,676 B2*  5/2011  Wakita et al. ............... 514/44 R

FOREIGN PATENT DOCUMENTS

| EP | 1801209 A1 | 6/2007 |
|----|-----------|--------|
| EP | 1930416 A1 | 6/2008 |
| WO | 9904008 A2 | 1/1999 |
| WO | WO 2004/104198 A1 * | 2/2004 |
| WO | 2006096459 A2 | 9/2006 |
| WO | 2007037429 A1 | 4/2007 |

OTHER PUBLICATIONS

Gottwein et al., "Cutting the Gordian Knot—Development and Biological Relevance of Hepatitis C Virus Cell Culture Systems", Advances in Virus Research, 2008, pp. 51-133, vol. 71.
Gottwein et al., "Development and Characterization of Hepatitis C Virus Genotype 1-7 Cell Culture Systems: Role of CD91 and Scavenger Receptor Class B Type I and Effect of Antiviral Drugs", Hepatology, Oct. 9, 2008, pp. 364-377, vol. 49, No. 2.
Gottwein et al., "Novel Chimeric Cell Culture System for Hepatitis C Genotypes 1A, 1B, 3A and 4A", Annual Meeting of the European Association for the Study of the Liver, Apr. 2007, pp. S30, vol. 46, No. Suppl.
Gottwein et al., "Robust Hepatitis C Genotype 3a Cell Culture Releasing Adapted Intergenotypic 3a/2a (S52/JFH1) Viruses", Gastroenterology, Nov. 2007, pp. 1614-1626, vol. 133, No. 5, Elsevier, Philadelphia, PA.
Graham et al., "A Genotype 2b NS5B Polymerase with Novel Substitutions Supports Replication of a Chimeric HCV 1b: 2b Replicon Containing a Genotype 1b NS3-5A Background", Antiviral Research, Jan. 2006, pp. 24-30, vol. 69, No. 1, Elsevier Science BV., Amsterdam, NL.
International Preliminary Report on Patentability for PCT/DK2008/050333 dated Mar. 29, 2010.
Kato et al., "Efficient Replication of the Genotype 2a Hepatitis C Virus Subgenomic Replicon", Gastroenterology, Dec. 2003, pp. 1808-1817, vol. 125, No. 6, Elsevier, Philadelphia, PA.
Kaul et al., "Cell Culture Adaption of Hepatitis C Virus and in vivo Viability of an Adapted Varient", Journal of Virology, Dec. 2007, pp. 13168-13179, vol. 81, No. 23, The American Society for Microbiology, US.
Krieger et al., "Enhancement of Hepatitis C Virus RNA Replication by Cell Culture-Adaptive Mutations", Journal of Virology, May 2001, pp. 4614-4624, vol. 75, No. 10, The American Society for Microbiology, US.

(Continued)

*Primary Examiner* — Stacy B. Chen
(74) *Attorney, Agent, or Firm* — Thompson Coburn LLP; Charles P. Romano

(57) ABSTRACT

The present inventors developed hepatitis C virus 1a/2a and 1b/2a intergenotypic recombinants in which the JFH1 structural genes (Core, E1 and E2), p7 and NS2 were replaced by the corresponding genes of the genotype Ia reference strain H77C or TN or the corresponding genes of the genotype Ib reference strain J4. Sequence analysis of recovered 1a/2a and 1b/2a recombinants from 2 serial passages and subsequent reverse genetic studies revealed adaptive mutations in e.g. p7, NS2 and/or NS3. In addition, the inventors demonstrate the possibility of using adaptive mutations identified for one HCV isolate in generating efficient cell culture systems for other isolates by transfer of mutations across isolates, subtypes or major genotypes. Furthermore neutralization studies showed that viruses of e.g. genotype 1 were efficiently neutralized by genotype Ia, 4a and 5a serum, an effect that could be utilized e.g. in vaccine development and immunological prophylaxis. The inventors in addition demonstrate the use of the developed systems for screening of antiviral substances in vitro and functional studies of the virus, e.g. identification of receptors required for HCV entry.

10 Claims, 30 Drawing Sheets

(56) References Cited

OTHER PUBLICATIONS

Figure 1:
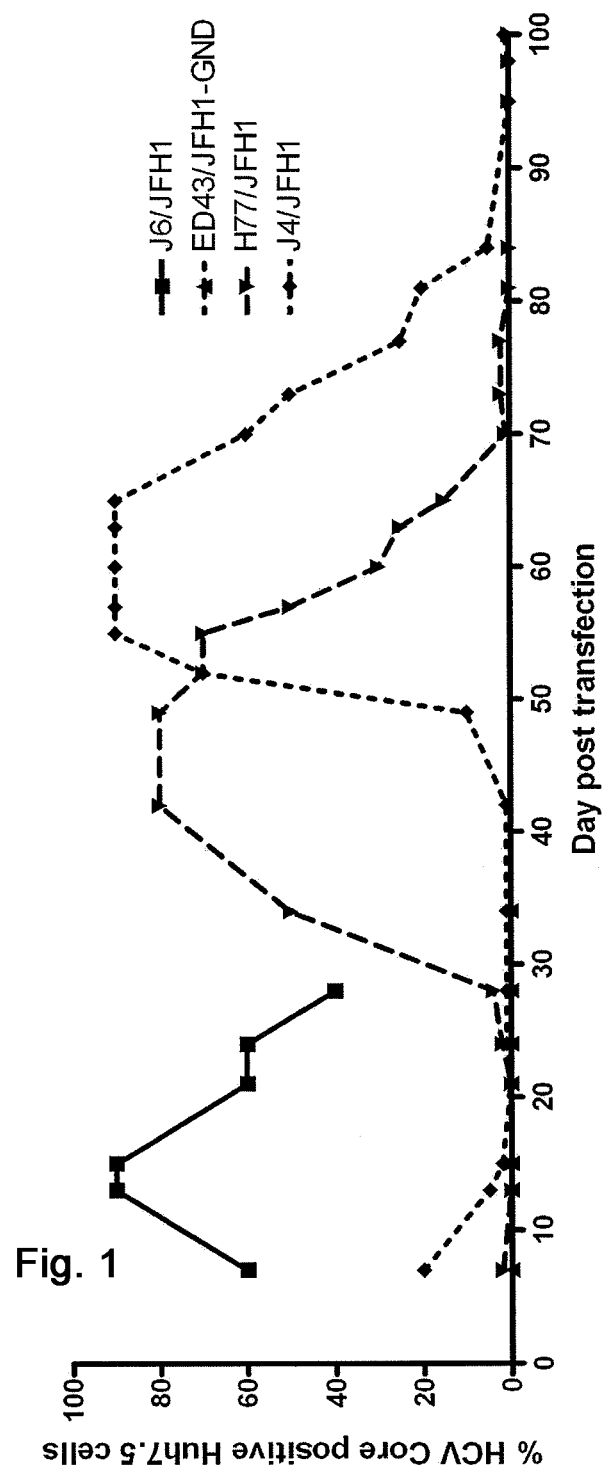

Lindenbach et al., "Complete Replication of Hepatitis C Virus in Cell Culture", Science, Jul. 22, 2005, pp. 623-626, vol. 309, No. 5734.

Lohmann et al., "Mutation in Hepatitis C Virus RNAs Conferring Cell Culture Adaptation", Journal of Virology, Feb. 2001, pp. 1437-1449, vol. 75, No. 3, The American Society for Microbiology, US.

Pietschmann et al., "Construction and Characterization of Infectious Intragenotypic and Intergenotypic Hepatitis C Virus Chimeras", Proceedings of the National Academy of Science of USA, May 9, 2006, pp. 7408-7413, vol. 103, No. 19, National Academy of Science, Washington D.C.

Sakai et al., "In Vivo Study of the HC-TN Strain of Hepatitis C Virus Recovered from a Patient with Fulminant Hepatitis: TNA Transcripts of a Molecular Clone (pHC-TN) are Infectious in Chimpanzees But Not in Huh7.5 Cells", Journal of Virology, Jul. 2007, pp. 7208-7219, vol. 81, No. 13, American Society for Microbiology.

Scheel et al., "Development of JFH1-based Cell Culture Systems for Hepatitis C Virus Genotype 4a and Evidence for Cross-Genotype Neutralization", Proceedings of the National Academy of Science of USA, Jan. 22, 2008, pp. 997-1002, vol. 105, No. 3, National Academy of Science, Washington D.C., US.

Wakita et al., "Production of Infectious Hepatitis C Virus in Tissue Culture from a Cloned Viral Genome", Nature Medicine, Jul. 2005, pp. 791-796, vol. 11, No. 7, Nature Publishing Group, New York, NY.

Yanagi et al., "Transcripts of a Chimeric cDNA Clone of Hepatitis C Virus Genotype 1b are Infectious in vivo", Virology, Jan. 1, 1998, pp. 161-172, vol. 244, No. 1.

Yi et al., "Compensatory Mutations in E1, p7, NS2, and NS3 Enhance Yields of Cell Culture-Infectious Intergenotypic Chimeric Hepatitis C Virus", Journal of Virology, Jan. 2007, pp. 629-638, vol. 81, No. 2, American Society for Microbiology, US.

Hui et al., "Interferon and Ribavirin Therapy for Chronic Hepatitis C Virus Genotype 6: A Comparison with Genotype 1", Article, Apr. 1, 2003, pp. 1071-1074, vol. 87.

GenBank Accession No. AB047639.1, HCV JFH1 complete genomic RNA, Nov. 12, 2005.

\* cited by examiner

Fig. 22b

EFFICIENT CELL CULTURE SYSTEM FOR HEPATITIS C VIRUS GENOTYPE 1A AND 1B

FIELD OF THE INVENTION

The present invention provides infectious recombinant hepatitis C genotype 1 viruses (HCV), and vectors, cells and animals comprising the same. The present invention provides methods of producing the infectious recombinant HCV genotype 1, and their use in identifying anti-HCV therapeutics including use in vaccines and diagnostics, as well as sequences of HCV associated with HCV pathogenesis.

BACKGROUND

Hepatitis C is one of the most widespread infectious diseases in the world. About 180 million people are infected with hepatitis C virus (HCV) worldwide with a yearly incidence of 3-4 million. While the acute phase of infection is mostly asymptomatic, the majority of acutely infected individuals develops chronic hepatitis and is at increased risk of developing liver cirrhosis and hepatocellular carcinoma. Thus, HCV infection is a major contributor to end-stage liver disease and in developed countries to liver transplantation.

HCV is a small, enveloped virus classified as a member of the Flaviviridae family. Its genome consists of a 9.6 kb single stranded RNA of positive polarity composed of 5' and 3' untranslated regions (UTR) and one long open reading frame (ORF) encoding a polyprotein, which is co- and posttranslationally cleaved and thus yields the structural (Core, E1, E2), p7 and nonstructural (NS2, NS3, NS4A, NS4B, NS5A, NS5B) proteins.

HCV isolates from around the world exhibit significant genetic heterogeneity. At least 6 major HCV genotypes (genotypes 1-6) have been identified, which differ by 31-33% at the nucleotide level and deduced amino acid level. In addition, there are numerous subtypes (a, b, c, etc.), which differ by 20-25% on the nucleotide and deduced amino acid level.

Genotype 1 is the most predominant genotype world wide, especially in the western world. While the only approved treatment for chronic HCV infection, combination therapy with interferon-α and ribavirin, leads to a sustained virologic response in most of genotype 2 or 3 patients, viral clearance is only obtained for about half of patients with genotype 1 or 4. There is no vaccine against HCV. Recently, a genotype 7a was discovered in Canadian and Belgian patients, who presumably were infected in Central Africa.

Since its discovery in 1989, research on HCV has been hampered by the lack of appropriate cell culture systems allowing for research on the complete viral life cycle as well as new therapeutics and vaccines.

In 2001, a genotype 2a isolate (JFH1) was described, which yielded high RNA titers in the replicon system without adaptive mutations.

A major breakthrough occurred in 2005, when formation of infectious viral particles was reported after transfection of RNA transcripts from the JFH1 full-length consensus cDNA clone into Huh7 cells.

At the same time, Lindenbach et al. demonstrated that the intragenotypic 2a/2a recombinant genome (J6/JFH1), in which the structural genes (C, E1, E2), p7 and NS2 of JFH1 were replaced by the respective genes of clone J6CF, produced infectious viral particles in Huh7.5 cells (a cell line derived from bulk Huh7 cells) with an accelerated kinetic (Lindenbach et al., 2005). Cell culture derived J6/JFH viruses were apparently fully viable in vivo.

Despite the importance of the described cell culture systems they represent only a single subtype (genotype 2a) of HCV. It is important to develop cell culture systems for representative strains of other HCV genotypes, since neutralizing antibodies are not expected to cross-neutralize all genotypes and new specific antiviral compounds might have differential efficiencies against different genotypes. For the genotype specific study of the function of the structural proteins, p7 and NS2 as well as related therapeutics such as neutralizing antibodies, fusion inhibitors, ion-channel blockers and protease inhibitors, it would be sufficient to construct intergenotypic recombinant viruses in analogy to J6/JFH.

Pietschmann et al. 2006 disclose construction and characterization of infectious intragenotypic and intergenotypic hepatitis C virus recombinants. The authors created a series of recombinant genomes allowing production of infectious genotype 1a, 1b, 2a and 3a particles by constructing hybrid genomes between the JFH1 isolate and the HCV isolates: H77 (genotype 1a), Con1 (genotype 1b), J6 (genotype 2a) and 452 (genotype 3a) respectively.

The infectious titers of the 1a, 1b and 3a genotypes disclosed in Pietschmann et al. 2006 are not at a level sufficiently high for practical utilization in functional analysis, drug and vaccine development or other applications. For such applications, including screening of potential drugs and development of potential vaccine candidates, the skilled person will know that infectivity titers below $10^3$ TCID50/mL contain insufficient amounts of infectious virus.

Accordingly, the study does not attempt cell culture adaptation of the genotype recombinants, e.g. by serial passage of cell culture derived viruses to naïve cells and it is not investigated whether adaptive mutations develop after transfection in cell culture. In fact, Pietschmann et al does not even provide any sequence data of the virus produced in the cell culture.

Similarly, Sakai et al. 2007 disclose construction of a 1a/JFH1 construct based on the TN (1a) isolate. However, this study does not demonstrate any production of infectious viral particles in culture. Neither is adaptation of the construct to cell culture demonstrated.

SUMMARY OF THE INVENTION

In this study, the present inventors used the H77C, TN and J4 reference isolates (genotype 1a, 1a and 1b, respectively) to construct viable, JFH1-based genomes. The present inventors serially passaged H77C/JFH1, TN/JFH1 and J4/JFH1 virus in cell culture and obtained both high infectivity titers, high HCV RNA titers and identified adaptive mutations required for efficient growth.

The present inventors have developed robust cell culture systems for HCV genotype 1a and 1b. This is an important advance for the study of HCV, since it permits detailed molecular studies of HCV and enhances the potential for developing broadly reactive reagents against HCV, including but not limited to small molecule drugs, antibodies and vaccines. Accordingly, the present invention may be used for individualised treatment of patients infected with one of the six major genotypes.

In one aspect the present invention relates to a replicating RNA comprising the structural genes (Core, E1, E2), p7 and the non-structural gene NS2 of genotype 1a or 1b and the non-structural genes NS3, NS4A, NS4B, NS5A and NS5B and part of NS2 from the JFH1 strain.

In another aspect the present invention pertains to an isolated nucleic acid molecule which encodes human hepatitis C virus of genotypes 1a/JFH1 or 1b/JFH1, wherein said molecule is capable of expressing said virus when transfected into cells.

In yet another aspect the present invention pertains to a composition comprising a nucleic acid molecule according to the present invention, a cassette vector for cloning viral genomes, methods for producing a cell which replicates HCV 1a/JFH1 and 1b/JFH1 RNA and cells obtainable there from.

In another aspect the present invention pertains to methods for producing a hepatitis C virus particle, methods for in vitro producing a hepatitis C virus-infected cell.

In a further aspect the present invention pertains to methods for screening an anti-hepatitis C virus substance, hepatitis C vaccines comprising a hepatitis C virus particle, methods for producing a hepatitis C virus vaccine and antibodies against hepatitis C virus.

DETAILED DESCRIPTION

The present invention advantageously provides hepatitis C virus (HCV) nucleotide sequences capable of replication, expression of functional HCV proteins, and infection in vivo and in vitro for development of antiviral therapeutics and diagnostics.

Nucleic Acid Molecules (cDNA Clones and RNA Transcripts)

In a broad aspect, the present invention is directed to a genetically engineered hepatitis C virus (HCV) encoded by nucleic acid sequences such as a complementary DNA (cDNA) sequence and replicating RNA (H77C/JFH1, TN/JFH1 or J4/JFH1) comprising the structural genes (Core, E1, E2), p7 and the non-structural gene NS2 of genotype 1a or 1b (e.g. strain H77C, TN and J4, genbank accession numbers AF011751, EF621489 and AF054247, respectively) and the non-structural genes NS3, NS4A, NS4B, NS5A and NS5B from the JFH1 strain (genotype 2a, genbank accession number AB047639).

In an embodiment the present invention is directed to a genetically engineered hepatitis C virus (HCV) encoded by nucleic acid sequences such as a complementary DNA (cDNA) sequence and replicating RNA (DBN/JFH1) comprising the structural genes (Core, E1, E2), p7 and the non-structural gene NS2 of genotype 3a (e.g. strain DBN) and the non-structural genes NS3, NS4A, NS4B, NS5A and NS5B from the JFH1 strain (genotype 2a, genbank accession number AB047639).

Thus in one embodiment, the present invention relates to a replicating RNA comprising the structural genes (Core, E1, E2), p7 and the non-structural gene NS2 of genotype 1a, 1b or 3a and the non-structural genes NS3, NS4A, NS4B, NS5A and NS5B from the JFH1 strain.

In another embodiment the genotype 1a is of the strain H77C or TN and the genotype 1b is of the strain J4.

In a further embodiment the genotype 3a is of the strain DBN.

The invention provides an isolated nucleic acid molecule encoding an infectious recombinant HCV genome, which nucleic acid comprises an intergenotypic HCV genome. In one embodiment, the intergenotypic HCV genome comprises sequences encoding structural genes (Core, E1, E2), p7 and nonstructural genes (NS2) from a first HCV strain, and sequences encoding the 5' untranslated region (UTR), non-structural genes NS3, NS4A, NS4B, NS5A, NS5B, and the 3' UTR from a second HCV strain.

In one embodiment, the first HCV strain and the second HCV strain are from different genotypes.

In one embodiment, the first HCV strain is strain H77C, and in another embodiment, the second HCV strain is strain JFH1.

In another embodiment, the first HCV strain is strain TN, and in another embodiment, the second HCV strain is strain JFH1.

In another embodiment, the first HCV strain is strain J4, and in another embodiment, the second HCV strain is strain JFH1.

In another embodiment, the first HCV strain is strain DBN, and in another embodiment, the second HCV strain is strain JFH1.

In another embodiment, the first HCV strain is of genotype 1a or 1b, and in another embodiment, the second HCV strain is strain JFH1.

In a further embodiment the 1a, 1b or 3a HCV strain is HCV isolated from a patient sample obtained from the DAN-HEP database.

In a further embodiment, the 1a HCV strain is strain DH4 (Dan-Hep 4) and in another embodiment, the second HCV strain is strain JFH1.

In a further embodiment, the 1b HCV strain is strain DH1 or DH5 (Dan-Hep 1 or 5) and in another embodiment, the second HCV strain is strain JFH1.

In a further embodiment, the genotype 1 HCV strain is strain DH1, DH2, DH3, DH4, DH5, DH6 or DH7 (Dan-Hep 1 through 7) and in another embodiment, the second HCV strain is strain JFH1.

In a further embodiment, the 1a HCV strain is strain DK7, US11, DR4, DR1, DK9, SW1, S14 or S18 as described in Bukh et al. 1993 and in another embodiment, the second HCV strain is strain JFH1.

In a further embodiment, the 1b HCV strain is strain IND8, IND5, SW2, HK3, HK8, S45, D3, T3, HK5, HK4, US6, P10, SA10, T10, DK1, S9 or D1 as described in Bukh et al. 1993 and in another embodiment, the second HCV strain is strain JFH1.

In a further embodiment, the genotype 3 HCV strain is strain DH11, DH12, DH13, DH14, DH15, DH16 or DH17 (Dan-Hep 11 through 17) and in another embodiment, the second HCV strain is strain JFH1.

In a further embodiment, the 3a HCV strain is strain DK12, HK10, S2, or S54 as described in Bukh et al. 1993 and in another embodiment, the second HCV strain is strain JFH1.

In one embodiment, the HCV nucleic acid molecule of the present invention comprises the nucleic acid sequence (cDNA) of H77C/JFH1 (SEQ ID NO: 1), TN/JFH1 (SEQ ID NO: 5), J4/JFH1 (SEQ ID NO: 3) or of DBN/JFH1 (SEQ ID NO: 75). In another embodiment the nucleic acid molecule has at least a functional portion of a sequence as shown in SEQ ID NO: 1, SEQ ID NO: 5, SEQ ID NO: 3 or SEQ ID NO: 75 which represents a specific embodiment of the present invention exemplified herein.

In yet an embodiment the nucleic acid molecule comprises the nucleic acid sequence with a sequence identity of at least 90% to that of SEQ ID NO: 1 and/or SEQ ID NO: 5 and/or SEQ ID NO: 3 and/or SEQ ID NO: 75.

In another embodiment, the nucleic acid comprises a sequence sharing at least 90% identity with that set forth in SEQ ID NO: 1, SEQ ID NO: 5, SEQ ID NO: 3 or SEQ ID NO: 75, such as 90% identity, 91% identity, 92% identity, 93% identity, 94% identity, 95% identity, 96% identity, 97% identity, 98% identity, or 99% identity.

As commonly defined "identity" is here defined as sequence identity between genes or proteins at the nucleotide or amino acid level, respectively.

Thus, in the present context "sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned.

To determine the percent identity of two amino acid sequences or of two nucleic acids, the sequences are aligned for optimal comparison purposes (e.g., gaps may be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

One may manually align the sequences and count the number of identical amino acids. Alternatively, alignment of two sequences for the determination of percent identity may be accomplished using a mathematical algorithm. Such an algorithm is incorporated into the NBLAST and XBLAST programs of (Altschul et al. 1990). BLAST nucleotide searches may be performed with the NBLAST program, score=100, wordlength=12, to obtain nucleotide sequences homologous to a nucleic acid molecules of the invention. BLAST protein searches may be performed with the XBLAST program, score=50, word-length=3 to obtain amino acid sequences homologous to a protein molecule of the invention. To obtain gapped alignments for comparison purposes, Gapped BLAST may be utilised. Alternatively, PSI-Blast may be used to perform an iterated search which detects distant relationships between molecules. When utilising the NBLAST, XBLAST, and Gapped BLAST programs, the default parameters of the respective programs may be used. See http://www.ncbi.nlm.nih.gov. Alternatively, sequence identity may be calculated after the sequences have been aligned e.g. by the BLAST program in the EMBL database (www.ncbi.nlm.gov/cgi-bin/BLAST). Generally, the default settings with respect to e.g. "scoring matrix" and "gap penalty" may be used for alignment. In the context of the present invention, the BLASTN and PSI BLAST default settings may be advantageous.

The percent identity between two sequences may be determined using techniques similar to those described above, with or without allowing gaps. In calculating percent identity, only exact matches are counted.

It should be noted that while SEQ ID NO: 1, SEQ ID NO: 5, SEQ ID NO: 3 and SEQ ID NO: 75 are DNA sequences, the present invention contemplates the corresponding RNA sequence, and DNA and RNA complementary sequences as well.

In a further embodiment the present invention pertains to a an isolated nucleic acid molecule which encodes human hepatitis C virus of genotype 1a/JFH1, wherein said molecule is capable of expressing said virus when transfected into cells and wherein said molecule encodes the amino acid sequence with a sequence identity of at least 90% to that of SEQ ID NO: 2 or SEQ ID NO: 6 and wherein the genotype 1a is strain H77C or TN.

In yet an embodiment the present invention pertains to an isolated nucleic acid molecule which encodes human hepatitis C virus of genotype 1b/JFH1, wherein said molecule is capable of expressing said virus when transfected into cells and wherein said molecule encodes the amino acid sequence with a sequence identity of at least 90% to that of SEQ ID NO: 4 and wherein the genotype 1b is strain J4.

In a further embodiment the present invention pertains to an isolated nucleic acid molecule which encodes human hepatitis C virus of genotype 3a/JFH1, wherein said molecule is capable of expressing said virus when transfected into cells and wherein said molecule encodes the amino acid sequence with a sequence identity of at least 90% to that of SEQ ID NO: 78 and wherein the genotype 3a is strain DBN.

In a further embodiment, a region from an HCV isolate is substituted for a corresponding region, e.g., of an HCV nucleic acid having a sequence of SEQ ID NO: 1, SEQ ID NO: 5, SEQ ID NO: 3 or SEQ ID NO: 75.

In another embodiment, the HCV nucleic acid is a DNA that codes on expression or after in vitro transcription for a replication-competent HCV RNA genome, or is itself a replication-competent HCV RNA genome.

In one embodiment, the HCV nucleic acid of the invention has a full-length sequence as depicted in or corresponding to SEQ ID NO: 1, SEQ ID NO: 5, SEQ ID NO: 3 or SEQ ID NO: 75. Various modifications for example of the 5' and 3' UTR are also contemplated by the invention. In another embodiment, the nucleic acid further comprises a reporter gene, which, in one embodiment, is a gene encoding neomycin phosphotransferase, Renilla luciferase, secreted alkaline phosphatase (SEAP), Gaussia luciferase or the green fluorescent protein.

Naturally, as noted above, the HCV nucleic acid sequences of the invention are selected from the group consisting of double stranded DNA, positive-sense cDNA, or negative-sense cDNA, or positive-sense RNA or negative-sense RNA or double stranded RNA. Thus, where particular sequences of nucleic acids of the invention are set forth, both DNA and corresponding RNA are intended, including positive and negative strands thereof.

In a further embodiment, the nucleic acid sequence of SEQ ID NO: 1, SEQ ID NO: 5, SEQ ID NO: 3 or SEQ ID NO: 75 or the said nucleic acid sequence with any mutation described in this document is obtained by any other means than what is described above.

In another embodiment, the complementary DNA (cDNA) provided by the present invention encodes human hepatitis C virus of genotype 1a/JFH1 or 1b/JFH1, wherein said molecule is capable of expressing said virus when transfected into cells and further capable of infectivity in vivo and wherein said molecule encodes the amino acid sequence of H77C/JFH1 (SEQ ID NO: 2), TN/JFH1 (SEQ ID NO: 6) or J4/JFH1 (SEQ ID NO: 4).

In another embodiment, the complementary DNA (cDNA) provided by the present invention encodes human hepatitis C virus of genotype 3a/JFH1, wherein said molecule is capable of expressing said virus when transfected into cells and further capable of infectivity in vivo and wherein said molecule encodes the amino acid sequence of DBN/JFH1 (SEQ ID NO: 78).

According to various aspects of the invention, HCV nucleic acid, including the polyprotein coding region, can be mutated or engineered to produce variants or derivatives with, e.g., silent mutations, conservative mutations, etc. In a further preferred aspect, silent nucleotide changes in the polyprotein coding regions (i.e., variations of the first, second or third base of a codon leading to a new codon that encodes the same amino acid) are incorporated as markers of specific HCV clones.

Thus, one aspect of the present invention relates to any of the amino acid sequences disclosed herein, such as but not limited to SEQ ID NO: 2, SEQ ID NO: 6, SEQ ID NO: 4 or SEQ ID NO: 78.

In yet an embodiment the isolated nucleic acid molecule encodes the amino acid sequence with a sequence identity of at least 90% to that of SEQ ID NO: 2 and/or SEQ ID NO: 6 and/or SEQ ID NO: 4 and/or SEQ ID NO: 78.

In another embodiment, the amino acid sequences comprises a sequence sharing at least 90% identity with that set forth in SEQ ID NO: 2 and/or SEQ ID NO: 6 and/or SEQ ID NO: 4 and/or SEQ ID NO: 78, such as 90% identity, 91% identity, 92% identity, 93% identity, 94% identity, 95% identity, 96% identity, 97% identity, 98% identity, or 99% identity.

It is to be understood that a sequence identity of at least 90%, such as 90% identity, 91% identity, 92% identity, 93% identity, 94% identity, 95% identity, 96% identity, 97% identity, 98% identity, or 99% identity applies to all sequences disclosed in the present application.

Nucleic acid molecules according to the present invention may be inserted in a plasmid vector for translation of the corresponding HCV RNA. Thus, the HCV DNA may comprise a promoter 5' of the 5'-UTR on positive-sense DNA, whereby transcription of template DNA from the promoter produces replication-competent RNA. The promoter can be selected from the group consisting of a eukaryotic promoter, yeast promoter, plant promoter, bacterial promoter, or viral promoter.

In one embodiment the present invention provides a cassette vector for cloning viral genomes, comprising, inserted therein, the nucleic acid sequence according to the invention and having an active promoter upstream thereof.

Adaptive Mutations

Adapted mutants of a HCV-cDNA construct or HCV-RNA full-length genome with improved abilities to generate infectious viral particles in cell culture compared to the original HCV-cDNA construct or the original HCV-RNA full-length genome are characterized in that they are obtainable by a method in which the type and number of mutations in a cell culture adapted HCV-RNA genome are determined through sequence analysis and sequence comparison and these mutations are introduced into a HCV-cDNA construct, particularly a HCV-cDNA construct according to the present invention, or into an (isolated) HCV-RNA full-length genome, either by site-directed mutagenesis, or by exchange of DNA fragments containing the relevant mutations.

The present inventors here report adaptive mutations, which allow efficient formation and release of viral particles in cell culture, and thus the present invention relates to these adaptive mutations in the present use as well as use in other strains by changing equivalent positions of such genomes to the adapted nucleotide or amino acid described.

A group of preferred HCV-cDNA constructs, HCV-RNA full-length genomes with the ability to release viral particles in cell culture, which are consequently highly suitable for practical use, is characterized in that it contains one, several or all of the nucleic acid exchanges listed below and/or one or several or all of the following amino acid exchanges.

Figure 2:
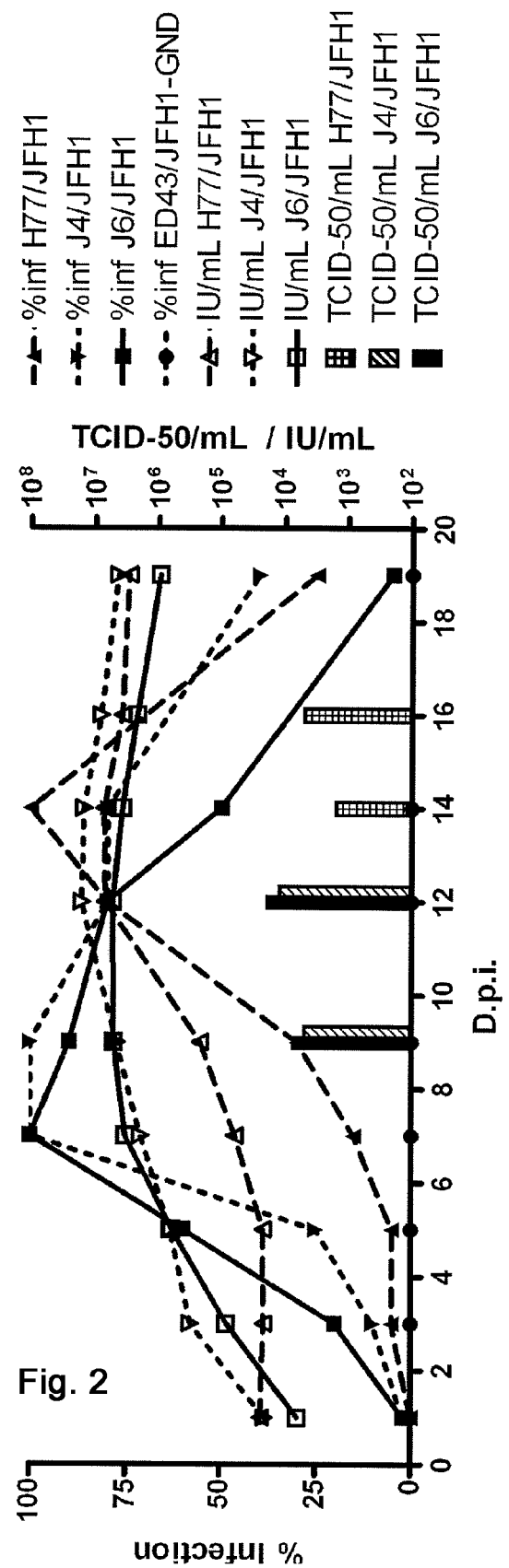
Figure 3:
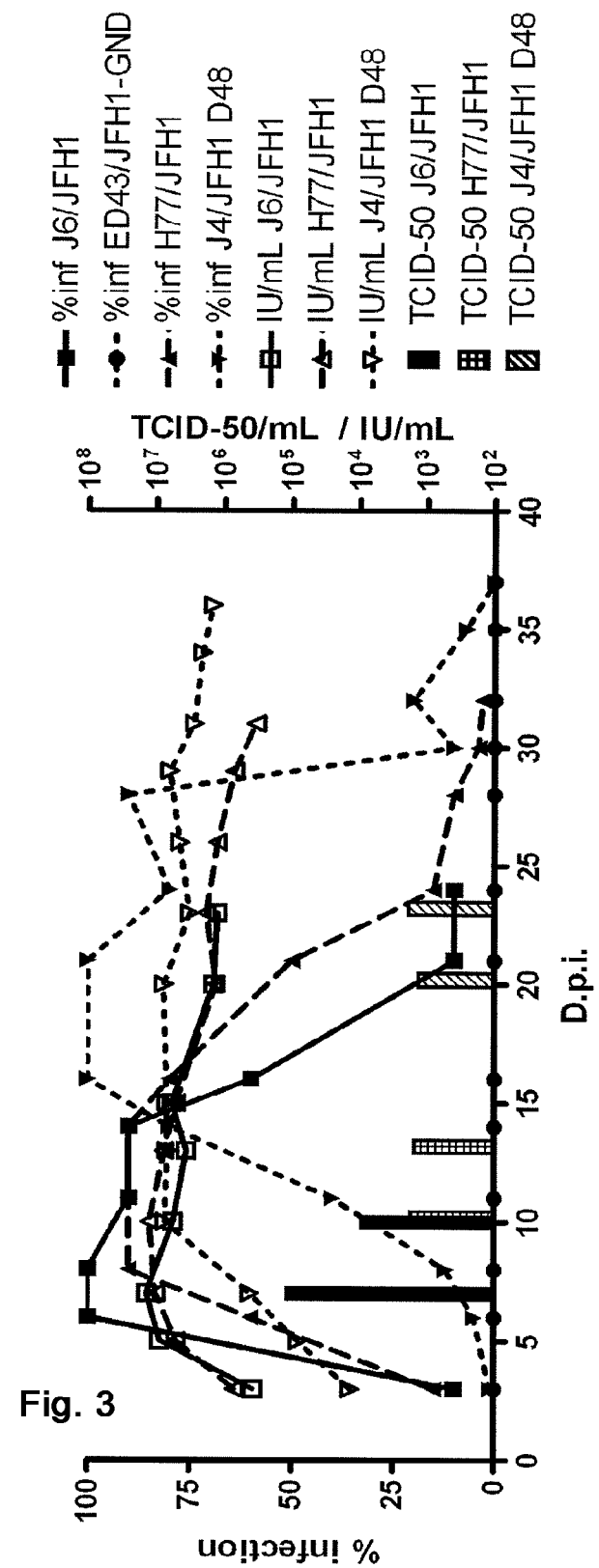

While the J6/JFH control virus immediately spread in culture after transfection, H77C/JFH1, TN/JFH1 and J4/JFH1 required an adaptation phase of variable length preceding spread of infection in culture. However, in subsequent passages of infectious virus to naïve cells, H77C/JFH1, TN/JFH1 and J4/JFH1 spread immediately, indicating acquisition of adaptive mutations (FIGS. 1, 2 and 3).

Figure 4:
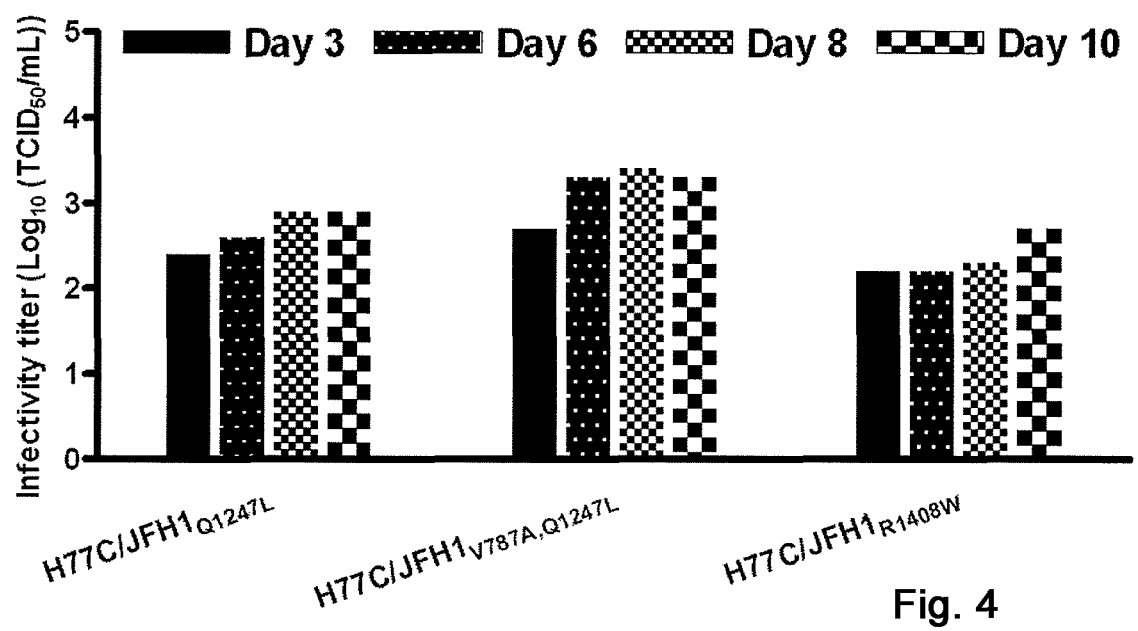
Figure 6:
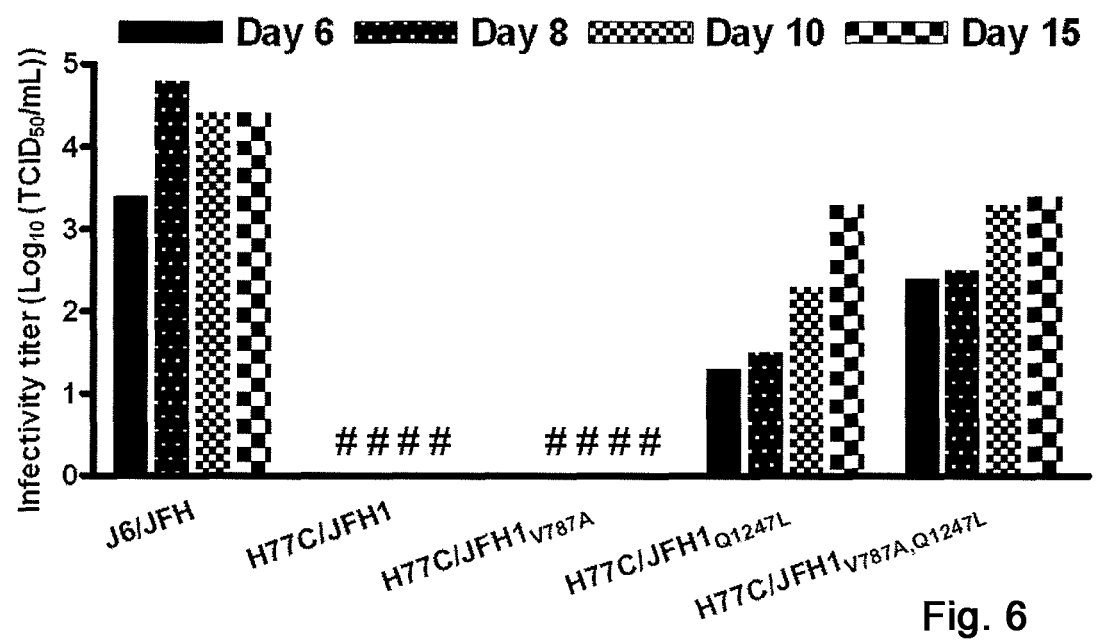
Figure 7:
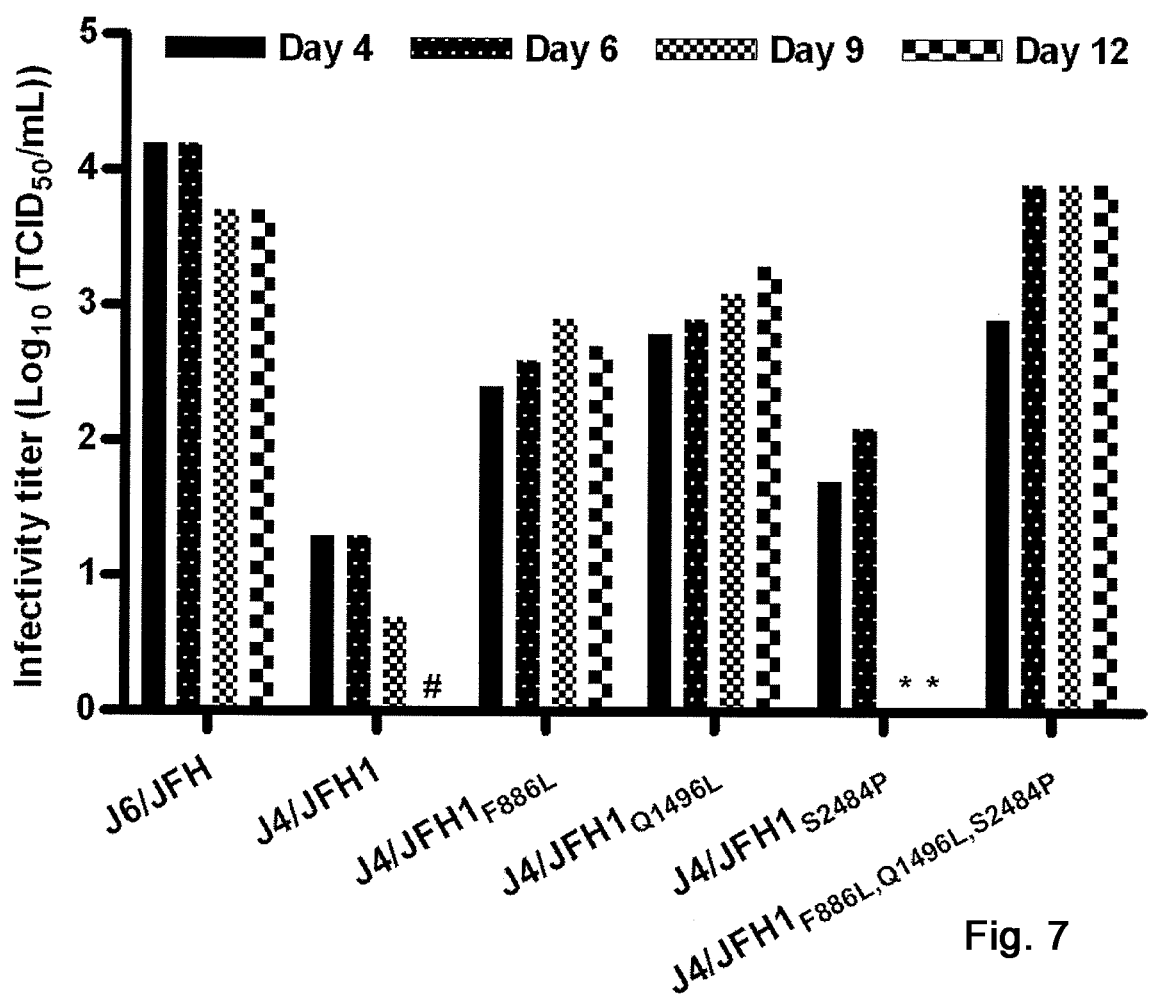
Figure 8:
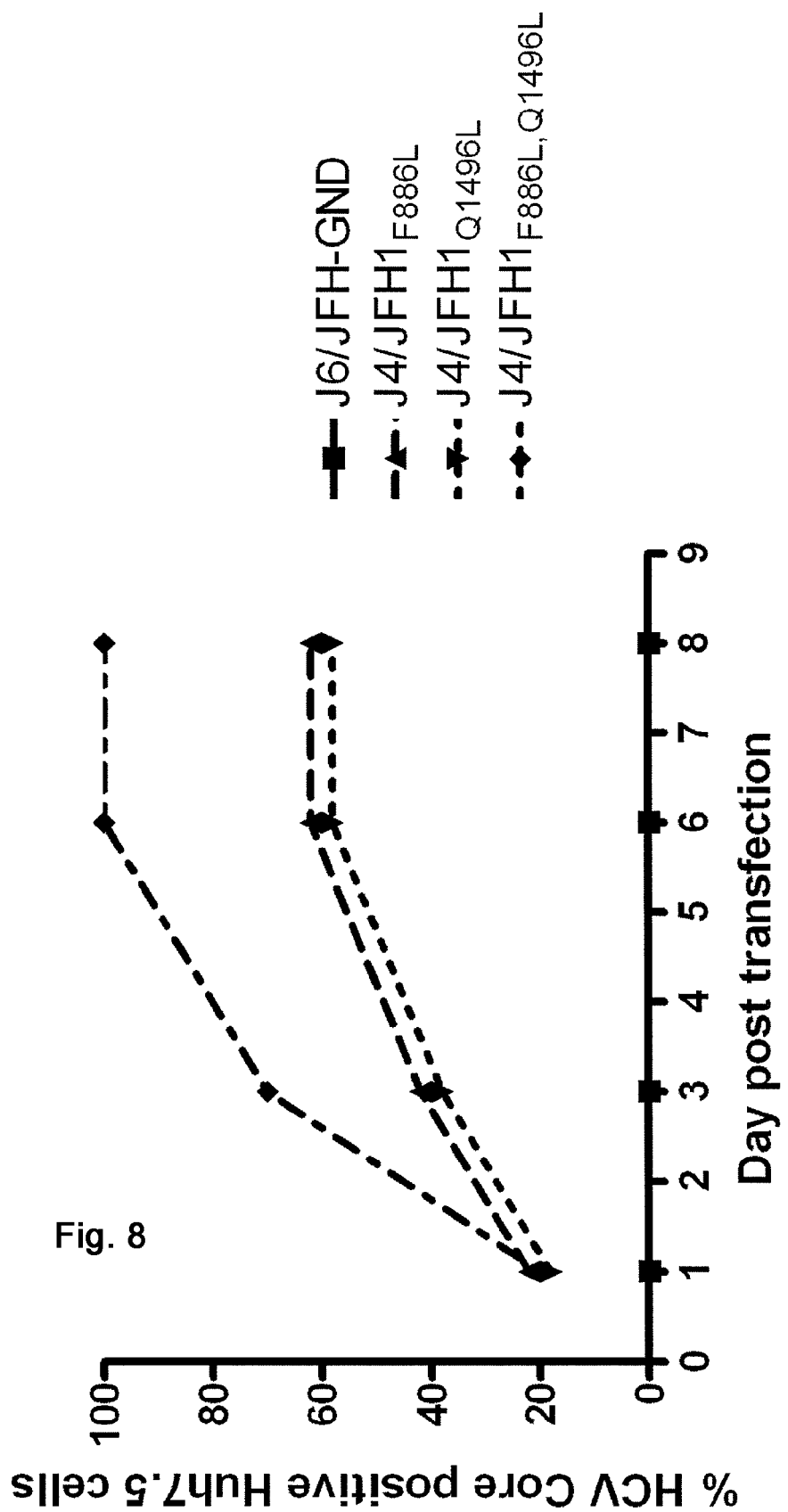

Sequencing of $1^{st}$ and $2^{nd}$ passage virus released to supernatant showed that both H77C/JFH1, TN/JFH1 and J4/JFH1 acquired putative adaptive mutations (Table 1, and 6, nucleotide and amino acid positions refer to the deposited SEQ ID NO: 1, 2, 3, 4, 5 and 6). Important mutations were subsequently tested in reverse genetic studies, showing the dependence on such. Although H77C/JFH1 mutants with Q1247L or R1408W in NS3 conferred efficient growth in Huh7.5 cells, combination of Q1247L with V787A in p7 led to accelerated kinetics in Huh7.5 cells (FIGS. 4 and 6). For J4/JFH1 both F886L in NS2 and Q1496L in NS3 conferred efficient growth in cell culture. However, when these two mutations where combined (F886L, Q1496L) or further combined with S2484P in NS5B (F886L, Q1496L, S2484P) accelerated kinetics and higher infectivity titers where observed (FIGS. 7 and 8). After a long adaptation phase in transfection culture, the TN/JFH1 had acquired mutations D1431N in NS3 and E1699G in NS4A. In a study on 3a/JFH1 viruses (Gottwein et al.), it was similarly found that a single mutation in NS3 (A3626G) allowed production of infectious particles, emphasizing the importance of NS3 mutations in JFH1-based recombinants of various genotypes.

To test various adaptive mutations and combinations thereof, the following constructs were made, and found to efficiently produce infectious viral particles in culture after transfection with no need of further adaptation (Table 1, 2, 6, 7 and 8); H77C/JFH1$_{V787A,Q1247L}$; H77C/JFH1$_{Q1247L}$; H77C/JFH1$_{R1408W}$; J4/JFH1$_{F886L,Q1496L}$; J4/JFH1$_{F886L,Q1496L,S2484P}$; J4/JFH1$_{K1398Q}$; J4/JFH1$_{R1408W}$; TN/JFH1$_{Q1247L}$; TN/JFH1$_{R1408W}$; TN/JFH1$_{V787A,Q1247L}$; TN/JFH1$_{D1431N,E1699G}$ (SEQ ID NO: 8, 9, 10, 16, 17, 20, 21, 22, 23, 24 and 84). The following constructs were made, and found to efficiently produce infectious viral particles in culture after transfection, but however required further adaptation (Table 1, 2, 6, 7 and 8): H77C/JFH1$_{V787A}$; H77C/JFH1$_{I1312V}$; H77C/JFH1$_{K1398Q}$; H77C/JFH1$_{Q1496L}$; J4/JFH1$_{F886L}$; H4/JFH1$_{Q1496L}$; J4/JFH1$_{S2484P}$; J4/JFH1$_{Q1247L}$; J4/JFH1$_{I1312V}$; TN/JFH1$_{D1431N}$; TN/JFH1$_{E1699G}$ (SEQ ID NO: 7, 11, 12, 13, 14, 15, 18, 19, 81, 82 and 83).

When sequencing HCV genomes from the supernatant of H77/JFH1 infected cell cultures, the following changes at the nucleotide level were observed at least once; C791T, G1064A, T1421C, G2245A, T2700C, T2887C, A3211G, A4080T, A4274G, A4532C, A4536T, C4562T, A4827T, G5161T, C6039G, C6352G, A6846C, A7102T, and C7375A. These mutations caused the amino acid changes V242M, Y361H, V787A, Q1247L, I1312V, K1398Q, K1399M, R1408W, Q1496L, M1607I, A1900G and D2169A.

When sequencing HCV genomes from the supernatant of TN/JFH1 infected cell cultures, the following changes at the nucleotide level were observed at least once; C829T, C893T, C1981A, T2700C, A4080T, A4532C, C4562T, G4631A, A5436G, C5556T, T6638A, T6849C and T7137C. These mutations caused the amino acid changes V787A, Q1247L, K1398Q, R1408W, D1431N, E1699G, A1739V, S2100T, V2170A and I2266T.

When sequencing HCV genomes from the supernatant of J4/JFH1 infected cell cultures, the following changes at the nucleotide level were observed at least once; A1032G, T1193C, A1962G, A2067G, T2075C, T2937C, T2996C, T2997C, A3175C, A3403G, A4080T, A4225G, A4274G, A4532C, C4562T, C4582T, A4827T, C4972T, G5429A, T5752C, A6089C, G6148A, A6674G, T6758C, A6840T, A6893G, A7062G, A7113G, A7128G, T7148C, C7331T, T7649A, T7790C, A8047G G8666A and G9005A. These mutations caused the amino acid changes Q231R, F285L, N541S, N576S, V866A, F886L, F886V, F866I, Q1247L, I1312V, K1398Q, R1408W, Q1496L, R1408W, D1697N, N1917H, I2112V, F2140L, D2167V, T2185A, E2241G, E2258G, E2263G, C2270R, C2437S, S2484P, A2776P and V2889I.

One embodiment of the present invention relates to adaptive mutations, wherein the adaptive mutation is a mutation that can be observed by clonal or direct sequencing of recovered replicating genomes of SEQ ID NO: 1, SEQ ID NO: 5 or SEQ ID NO: 3.

In another embodiment the present invention relates to nucleic acid molecules comprising one or more adaptive mutations.

Thus in a further embodiment, the present invention relates to nucleic acid molecules according to the present invention, wherein said molecule comprises one or more adaptive mutations in p7, NS2 and NS3 singly or in combination.

In yet an embodiment, the present invention relates to nucleic acid molecules according to the present invention, wherein said one or more adaptive mutations is located in p7, NS2 and NS3 singly or in combination.

In the context of the present invention the term "adaptive mutation" is meant to cover mutations identified in passaged H77C/JFH1, TN/JFH1 or J4/JFH1 viruses that provide the original H77C/JFH1, TN/JFH1 and J4/JFH1 genomes and any other HCV sequence the ability to grow efficiently in culture. Furthermore all introductions of mutations into the H77C/JFH1, TN/JFH1 or J4/JFH1 sequences described, whether or not yielding better growth abilities, and the introduction of these mutations into any HCV sequence should be considered.

Thus the described mutations enable the HCV-RNA genome (e.g. derived from a HCV-cDNA clone) to form viral particles in and release these from suitable cell lines. In addition some of the described mutations might change the function of the concerned proteins in favourable ways, which might be exploited in other experimental systems employing these proteins. This also includes other HCV genomes with adaptive mutations, all of them, combinations of them or individual mutations, that grow in culture. In this case the titers might be lower than those listed.

It should be understood that any feature and/or aspect discussed above in connection with the mutations according to the invention apply by analogy to both single mutation and any combination of the mutations.

One embodiment of the present invention relates to adaptive mutations, wherein said adaptive mutation is at least one of the replacements of the first said nucleotide at the said position of SEQ ID NO 1 by the following said nucleotide selected from the group consisting of C791T, G1064A, T1421C, G2245A, T2700C, T2887C, A3211G, A4080T, A4274G, A4532C, A4536T, C4562T, A4827T, G5161T, C6039G, C6352G, A6846C, A7102T and C7375A.

One embodiment of the present invention relates to adaptive mutations, wherein said adaptive mutation is at least one of the replacements of the first said nucleotide at the said position of SEQ ID NO: 1 by the following said nucleotide selected from the group consisting of T2700C, A4080T, A4274G and C4562T.

One embodiment of the present invention relates to adaptive mutations, wherein said adaptive mutation is at least one of the replacements of the first said nucleotide at the said position of SEQ ID NO: 1 by the following said nucleotide selected from the group consisting of A4080T and C4562T.

One embodiment of the present invention relates to adaptive mutations, wherein said adaptive mutation is a replacement of C in position 791 of SEQ ID NO: 1 with T.

One embodiment of the present invention relates to adaptive mutations, wherein said adaptive mutation is a replacement of G in position 1064 of SEQ ID NO: 1 with A.

One embodiment of the present invention relates to adaptive mutations, wherein said adaptive mutation is a replacement of T in position 1421 of SEQ ID NO: 1 with C.

One embodiment of the present invention relates to adaptive mutations, wherein said adaptive mutation is a replacement of G in position 2245 of SEQ ID NO: 1 with A.

One embodiment of the present invention relates to adaptive mutations, wherein said adaptive mutation is a replacement of T in position 2700 of SEQ ID NO: 1 with C.

One embodiment of the present invention relates to adaptive mutations, wherein said adaptive mutation is a replacement of T in position 2887 of SEQ ID NO: 1 with C.

One embodiment of the present invention relates to adaptive mutations, wherein said adaptive mutation is a replacement of A in position 3211 of SEQ ID NO: 1 with G.

One embodiment of the present invention relates to adaptive mutations, wherein said adaptive mutation is a replacement of A in position 4080 of SEQ ID NO: 1 with T.

One embodiment of the present invention relates to adaptive mutations, wherein said adaptive mutation is a replacement of A in position 4274 of SEQ ID NO: 1 with G.

One embodiment of the present invention relates to adaptive mutations, wherein said adaptive mutation is a replacement of A in position 4536 of SEQ ID NO: 1 with C.

One embodiment of the present invention relates to adaptive mutations, wherein said adaptive mutation is a replacement of A in position 4536 of SEQ ID NO: 1 with T.

One embodiment of the present invention relates to adaptive mutations, wherein said adaptive mutation is a replacement of C in position 4562 of SEQ ID NO: 1 with T.

One embodiment of the present invention relates to adaptive mutations, wherein said adaptive mutation is a replacement of A in position 4827 of SEQ ID NO: 1 with T.

One embodiment of the present invention relates to adaptive mutations, wherein said adaptive mutation is a replacement of G in position 5161 of SEQ ID NO: 1 with T.

One embodiment of the present invention relates to adaptive mutations, wherein said adaptive mutation is a replacement of C in position 6039 of SEQ ID NO: 1 with G.

One embodiment of the present invention relates to adaptive mutations, wherein said adaptive mutation is a replacement of C in position 6352 of SEQ ID NO: 1 with G.

One embodiment of the present invention relates to adaptive mutations, wherein said adaptive mutation is a replacement of A in position 6846 of SEQ ID NO: 1 with C.

One embodiment of the present invention relates to adaptive mutations, wherein said adaptive mutation is a replacement of A in position 7102 of SEQ ID NO: 1 with T.

One embodiment of the present invention relates to adaptive mutations, wherein said adaptive mutation is a replacement of C in position 7375 of SEQ ID NO: 1 with A.

One embodiment of the present invention relates to adaptive mutations, wherein said adaptive mutation is at least one of the replacements of the first said nucleotide at the said position of SEQ ID NO: 3 by the following said nucleotide selected from the group consisting of A1032G, T1193C, A1962G, A2067G, T2075C, T2937C, T2996C, T2997C, A3175C, A3403G, A4080T, A4225G, A4274G, A4532C, C4562T, C4582T, A4827T, C4972T, G5429A, T5752C, A6089C, G6148A, A6674G, T6758C, A6840T, A6893G, A7062G, A7113G, A7128G, T7148C, C7331T, T7649A, T7790C, A8047G G8666A and G9005A.

One embodiment of the present invention relates to adaptive mutations, wherein said adaptive mutation is at least one of the replacements of the first said nucleotide at the said position of SEQ ID NO: 3 by the following said nucleotide selected from the group consisting T2996C, T2997C, A4274G, A4532C, A4562T and A4827T.

One embodiment of the present invention relates to adaptive mutations, wherein said adaptive mutation is at least one of the replacements of the first said nucleotide at the said position of SEQ ID NO: 3 by the following said nucleotide selected from the group consisting of T2996C, T2997C, and A4827T.

One embodiment of the present invention relates to adaptive mutations, wherein said adaptive mutation is a replacement of A in position 1032 of SEQ ID NO: 3 with G.

One embodiment of the present invention relates to adaptive mutations, wherein said adaptive mutation is a replacement of T in position 1193 of SEQ ID NO: 3 with C.

One embodiment of the present invention relates to adaptive mutations, wherein said adaptive mutation is a replacement of A in position 1962 of SEQ ID NO: 3 with G.

One embodiment of the present invention relates to adaptive mutations, wherein said adaptive mutation is a replacement of A in position 2067 of SEQ ID NO: 3 with G.

One embodiment of the present invention relates to adaptive mutations, wherein said adaptive mutation is a replacement of T in position 2075 of SEQ ID NO: 3 with C.

One embodiment of the present invention relates to adaptive mutations, wherein said adaptive mutation is a replacement of T in position 2937 of SEQ ID NO: 3 with C.

One embodiment of the present invention relates to adaptive mutations, wherein said adaptive mutation is a replacement of T in position 2996 of SEQ ID NO: 3 with C.

One embodiment of the present invention relates to adaptive mutations, wherein said adaptive mutation is a replacement of T in position 2997 of SEQ ID NO: 3 with C.

One embodiment of the present invention relates to adaptive mutations, wherein said adaptive mutation is a replacement of A in position 3403 of SEQ ID NO: 3 with G.

One embodiment of the present invention relates to adaptive mutations, wherein said adaptive mutation is a replacement of A in position 3175 of SEQ ID NO: 3 with C.

One embodiment of the present invention relates to adaptive mutations, wherein said adaptive mutation is a replacement of A in position 4080 of SEQ ID NO: 3 with T.

One embodiment of the present invention relates to adaptive mutations, wherein said adaptive mutation is a replacement of A in position 4225 of SEQ ID NO: 3 with G.

One embodiment of the present invention relates to adaptive mutations, wherein said adaptive mutation is a replacement of A in position 4274 of SEQ ID NO: 3 with G.

One embodiment of the present invention relates to adaptive mutations, wherein said adaptive mutation is a replacement of A in position 4532 of SEQ ID NO: 3 with C.

One embodiment of the present invention relates to adaptive mutations, wherein said adaptive mutation is a replacement of C in position 4562 of SEQ ID NO: 3 with T.

One embodiment of the present invention relates to adaptive mutations, wherein said adaptive mutation is a replacement of C in position 4582 of SEQ ID NO: 3 with T.

One embodiment of the present invention relates to adaptive mutations, wherein said adaptive mutation is a replacement of A in position 4827 of SEQ ID NO: 3 with T.

One embodiment of the present invention relates to adaptive mutations, wherein said adaptive mutation is a replacement of C in position 4972 of SEQ ID NO: 3 with T.

One embodiment of the present invention relates to adaptive mutations, wherein said adaptive mutation is a replacement of G in position 5429 of SEQ ID NO: 3 with A.

One embodiment of the present invention relates to adaptive mutations, wherein said adaptive mutation is a replacement of T in position 5752 of SEQ ID NO: 3 with C.

One embodiment of the present invention relates to adaptive mutations, wherein said adaptive mutation is a replacement of A in position 6089 of SEQ ID NO: 3 with C.

One embodiment of the present invention relates to adaptive mutations, wherein said adaptive mutation is a replacement of G in position 6148 of SEQ ID NO: 3 with A.

One embodiment of the present invention relates to adaptive mutations, wherein said adaptive mutation is a replacement of A in position 6674 of SEQ ID NO: 3 with G.

One embodiment of the present invention relates to adaptive mutations, wherein said adaptive mutation is a replacement of T in position 6758 of SEQ ID NO: 3 with C.

One embodiment of the present invention relates to adaptive mutations, wherein said adaptive mutation is a replacement of A in position 6840 of SEQ ID NO: 3 with T.

One embodiment of the present invention relates to adaptive mutations, wherein said adaptive mutation is a replacement of A in position 6893 of SEQ ID NO: 3 with G.

One embodiment of the present invention relates to adaptive mutations, wherein said adaptive mutation is a replacement of A in position 7062 of SEQ ID NO: 3 with G.

One embodiment of the present invention relates to adaptive mutations, wherein said adaptive mutation is a replacement of A in position 7113 of SEQ ID NO: 3 with G.

One embodiment of the present invention relates to adaptive mutations, wherein said adaptive mutation is a replacement of A in position 7128 of SEQ ID NO: 3 with G.

One embodiment of the present invention relates to adaptive mutations, wherein said adaptive mutation is a replacement of T in position 7148 of SEQ ID NO: 3 with C.

One embodiment of the present invention relates to adaptive mutations, wherein said adaptive mutation is a replacement of C in position 7331 of SEQ ID NO: 3 with T.

One embodiment of the present invention relates to adaptive mutations, wherein said adaptive mutation is a replacement of T in position 7649 of SEQ ID NO: 3 with A.

One embodiment of the present invention relates to adaptive mutations, wherein said adaptive mutation is a replacement of T in position 7790 of SEQ ID NO: 3 with C.

One embodiment of the present invention relates to adaptive mutations, wherein said adaptive mutation is a replacement of A in position 8047 of SEQ ID NO: 3 with G.

One embodiment of the present invention relates to adaptive mutations, wherein said adaptive mutation is a replacement of G in position 8666 of SEQ ID NO: 3 with A.

One embodiment of the present invention relates to adaptive mutations, wherein said adaptive mutation is a replacement of G in position 9005 of SEQ ID NO: 3 with A.

One embodiment of the present invention relates to adaptive mutations, wherein said adaptive mutation is at least one of the replacements of the first said nucleotide at the said position of SEQ ID NO: 5 by the following said nucleotide selected from the group consisting of C829T, C893T, C1981A, T2700C, A4080T, A4532C, C4562T, G4631A, A5436G, C5556T, T6638A, T6849C and T7137C.

One embodiment of the present invention relates to adaptive mutations, wherein said adaptive mutation is at least one of the replacements of the first said nucleotide at the said position of SEQ ID NO: 5 by the following said nucleotide selected from the group consisting T2700C, A4080T, A4532C, C4562T, G4631A and A5436G.

One embodiment of the present invention relates to adaptive mutations, wherein said adaptive mutation is at least one of the replacements of the first said nucleotide at the said position of SEQ ID NO: 5 by the following said nucleotide selected from the group consisting A4080T, A4532C, C4562T, G4631A and A5436G.

One embodiment of the present invention relates to adaptive mutations, wherein said adaptive mutation is a replacement of C in position 829 of SEQ ID NO: 5 with T.

One embodiment of the present invention relates to adaptive mutations, wherein said adaptive mutation is a replacement of C in position 893 of SEQ ID NO: 5 with T.

One embodiment of the present invention relates to adaptive mutations, wherein said adaptive mutation is a replacement of C in position 1981 of SEQ ID NO: 5 with A.

One embodiment of the present invention relates to adaptive mutations, wherein said adaptive mutation is a replacement of T in position 2700 of SEQ ID NO: 5 with C.

One embodiment of the present invention relates to adaptive mutations, wherein said adaptive mutation is a replacement of A in position 4080 of SEQ ID NO: 5 with T.

One embodiment of the present invention relates to adaptive mutations, wherein said adaptive mutation is a replacement of A in position 4532 of SEQ ID NO: 5 with C.

One embodiment of the present invention relates to adaptive mutations, wherein said adaptive mutation is a replacement of C in position 4562 of SEQ ID NO: 5 with T.

One embodiment of the present invention relates to adaptive mutations, wherein said adaptive mutation is a replacement of G in position 4631 of SEQ ID NO: 5 with A.

One embodiment of the present invention relates to adaptive mutations, wherein said adaptive mutation is a replacement of A in position 5436 of SEQ ID NO: 5 with G.

One embodiment of the present invention relates to adaptive mutations, wherein said adaptive mutation is a replacement of C in position 5556 of SEQ ID NO: 5 with T.

One embodiment of the present invention relates to adaptive mutations, wherein said adaptive mutation is a replacement of T in position 6638 of SEQ ID NO: 5 with A.

One embodiment of the present invention relates to adaptive mutations, wherein said adaptive mutation is a replacement of T in position 6849 of SEQ ID NO: 5 with C.

One embodiment of the present invention relates to adaptive mutations, wherein said adaptive mutation is a replacement of T in position 7137 of SEQ ID NO: 5 with C.

One embodiment of the present invention relates to adaptive mutations, wherein said adaptive mutation is at least one of the replacements of the first said nucleotide at the said position of SEQ ID NO: 75 by the following said nucleotide selected from the group consisting of C1619T, C2721G, T2873A, T2873C, A3626G, A4553C, C5326T, C5728T, G7199C and A7319G.

One embodiment of the present invention relates to adaptive mutations, wherein said adaptive mutation is at least one of the replacements of the first said nucleotide at the said position of SEQ ID NO: 75 by the following said nucleotide selected from the group consisting of T2873A, T2873C, A3626G and A4553C.

One embodiment of the present invention relates to adaptive mutations, wherein said adaptive mutation is at least one of the replacements of the first said nucleotide at the said position of SEQ ID NO: 75 by the following said nucleotide selected from the group consisting of A3626G.

One embodiment of the present invention relates to adaptive mutations, wherein said adaptive mutation is a replacement of C in position 1619 of SEQ ID NO: 75 with T.

One embodiment of the present invention relates to adaptive mutations, wherein said adaptive mutation is a replacement of C in position 2721 of SEQ ID NO: 75 with G.

One embodiment of the present invention relates to adaptive mutations, wherein said adaptive mutation is a replacement of T in position 2873 of SEQ ID NO: 75 with A.

One embodiment of the present invention relates to adaptive mutations, wherein said adaptive mutation is a replacement of T in position 2873 of SEQ ID NO: 75 with C.

One embodiment of the present invention relates to adaptive mutations, wherein said adaptive mutation is a replacement of A in position 3626 of SEQ ID NO: 75 with G.

One embodiment of the present invention relates to adaptive mutations, wherein said adaptive mutation is a replacement of A in position 4553 of SEQ ID NO: 75 with C.

One embodiment of the present invention relates to adaptive mutations, wherein said adaptive mutation is a replacement of C in position 5326 of SEQ ID NO: 75 with T.

One embodiment of the present invention relates to adaptive mutations, wherein said adaptive mutation is a replacement of C in position 5728 of SEQ ID NO: 75 with T.

One embodiment of the present invention relates to adaptive mutations, wherein said adaptive mutation is a replacement of G in position 7199 of SEQ ID NO: 75 with C.

One embodiment of the present invention relates to adaptive mutations, wherein said adaptive mutation is a replacement of A in position 7319 of SEQ ID NO: 75 with G.

In another embodiment all the amino acid changes observed herein are provided by the present application. The skilled addressee can easily obtain the same amino acid change by mutating another base of the codon and hence all means of obtaining the given amino acid sequence is intended.

One embodiment of the present invention relates to adaptive mutations, wherein said adaptive mutation is at least one of the replacements of the first said amino acid at the said position of SEQ ID NO 2 by the following said amino acid selected from the group consisting of V242M, Y361H, V787A, Q1247L, I1312V, K1398Q, K1399M, R1408W, Q1496L, M1607I, A1900G and D2169A.

One embodiment of the present invention relates to adaptive mutations, wherein said adaptive mutation is at least one of the replacements of the first said amino acid at the said position of SEQ ID NO 2 by the following said amino acid selected from the group consisting of V787A, Q1247L, I1312V and R1408W.

One embodiment of the present invention relates to adaptive mutations, wherein said adaptive mutation is at least one of the replacements of the first said amino acid at the said position of SEQ ID NO 2 by the following said amino acid selected from the group consisting of Q1247L and R1408W.

Another embodiment of the present invention relates said adaptive mutation is a replacement of V in position 242 of SEQ ID NO: 2 with M.

Another embodiment of the present invention relates said adaptive mutation is a replacement of Y in position 361 of SEQ ID NO: 2 with H.

Another embodiment of the present invention relates said adaptive mutation is a replacement of V in position 787 of SEQ ID NO: 2 with A.

Another embodiment of the present invention relates said adaptive mutation is a replacement of Q in position 1247 of SEQ ID NO: 2 with L.

Another embodiment of the present invention relates said adaptive mutation is a replacement of I in position 1312 of SEQ ID NO: 2 with V.

Another embodiment of the present invention relates said adaptive mutation is a replacement of K in position 1398 of SEQ ID NO: 2 with Q.

Another embodiment of the present invention relates said adaptive mutation is a replacement of K in position 1399 of SEQ ID NO: 2 with M.

Another embodiment of the present invention relates said adaptive mutation is a replacement of R in position 1408 of SEQ ID NO: 2 with W.

Another embodiment of the present invention relates said adaptive mutation is a replacement of Q in position 1496 of SEQ ID NO: 2 with L.

Another embodiment of the present invention relates said adaptive mutation is a replacement of M in position 1607 of SEQ ID NO: 2 with I.

Another embodiment of the present invention relates said adaptive mutation is a replacement of A in position 1900 of SEQ ID NO: 2 with G.

Another embodiment of the present invention relates said adaptive mutation is a replacement of D in position 2169 of SEQ ID NO: 2 with A.

One embodiment of the present invention relates to adaptive mutations, wherein said adaptive mutation is at least one of the replacements of the first said amino acid at the said position of SEQ ID NO 4 by the following said amino acid selected from the group consisting of Q231R, F285L, N541S, N576S, V866A, F886L, F886V, F886I, Q1247L, I1312V, K1398Q, R1408W, Q1496L, R1408W, D1697N, N1917H, I2112V, F2140L, D2167V, T2185A, E2241G, E2258G, E2263G, C2270R, C2437S, S2484P, A2776P and V2889I.

One embodiment of the present invention relates to adaptive mutations, wherein said adaptive mutation is at least one of the replacements of the first said amino acid at the said position of SEQ ID NO 4 by the following said amino acid selected from the group consisting of F886L, F886V, F886I, I1312V, K1398Q, R1408W and Q1496L.

One embodiment of the present invention relates to adaptive mutations, wherein said adaptive mutation is at least one of the replacements of the first said amino acid at the said position of SEQ ID NO: 4 by the following said amino acid selected from the group consisting of F886L and Q1496L.

Another embodiment of the present invention relates said adaptive mutation is a replacement of Q in position 231 of SEQ ID NO: 4 with R.

Another embodiment of the present invention relates said adaptive mutation is a replacement of F in position 285 of SEQ ID NO: 4 with L.

Another embodiment of the present invention relates said adaptive mutation is a replacement of N in position 541 of SEQ ID NO: 4 with S.

Another embodiment of the present invention relates said adaptive mutation is a replacement of N in position 576 of SEQ ID NO: 4 with S.

Another embodiment of the present invention relates said adaptive mutation is a replacement of V in position 866 of SEQ ID NO: 4 with A.

Another embodiment of the present invention relates said adaptive mutation is a replacement of F in position 886 of SEQ ID NO: 4 with L.

Another embodiment of the present invention relates said adaptive mutation is a replacement of F in position 886 of SEQ ID NO: 4 with V.

Another embodiment of the present invention relates said adaptive mutation is a replacement of F in position 886 of SEQ ID NO: 4 with I.

Another embodiment of the present invention relates said adaptive mutation is a replacement of Q in position 1247 of SEQ ID NO: 4 with L.

Another embodiment of the present invention relates said adaptive mutation is a replacement of I in position 1312 of SEQ ID NO: 4 with V.

Another embodiment of the present invention relates said adaptive mutation is a replacement of K in position 1398 of SEQ ID NO: 4 with Q Another embodiment of the present invention relates said adaptive mutation is a replacement of R in position 1408 of SEQ ID NO: 4 with W.

Another embodiment of the present invention relates said adaptive mutation is a replacement of Q in position 1496 of SEQ ID NO: 4 with L.

Another embodiment of the present invention relates said adaptive mutation is a replacement of D in position 1697 of SEQ ID NO: 4 with N.

Another embodiment of the present invention relates said adaptive mutation is a replacement of N in position 1917 of SEQ ID NO: 4 with H.

Another embodiment of the present invention relates said adaptive mutation is a replacement of I in position 2112 of SEQ ID NO: 4 with V.

Another embodiment of the present invention relates said adaptive mutation is a replacement of F in position 2140 of SEQ ID NO: 4 with L.

Another embodiment of the present invention relates said adaptive mutation is a replacement of D in position 2167 of SEQ ID NO: 4 with V.

Another embodiment of the present invention relates said adaptive mutation is a replacement of T in position 2185 of SEQ ID NO: 4 with A.

Another embodiment of the present invention relates said adaptive mutation is a replacement of E in position 2214 of SEQ ID NO: 4 with G.

Another embodiment of the present invention relates said adaptive mutation is a replacement of E in position 2258 of SEQ ID NO: 4 with G.

Another embodiment of the present invention relates said adaptive mutation is a replacement of E in position 2263 of SEQ ID NO: 4 with G.

Another embodiment of the present invention relates said adaptive mutation is a replacement of C in position 2270 of SEQ ID NO: 4 with R.

Another embodiment of the present invention relates said adaptive mutation is a replacement of C in position 2437 of SEQ ID NO: 4 with S.

Another embodiment of the present invention relates said adaptive mutation is a replacement of S in position 2484 of SEQ ID NO: 4 with P.

Another embodiment of the present invention relates said adaptive mutation is a replacement of A in position 2776 of SEQ ID NO: 4 with P.

Another embodiment of the present invention relates said adaptive mutation is a replacement of V in position 2889 of SEQ ID NO: 4 with I.

One embodiment of the present invention relates to adaptive mutations, wherein said adaptive mutation is at least one of the replacements of the first said amino acid at the said position of SEQ ID NO 6 by the following said amino acid selected from the group consisting of V787A, Q1247L, K1398Q, R1408W, D1431N, E1699G, A1739V, S2100T, V2170A and I2266T.

One embodiment of the present invention relates to adaptive mutations, wherein said adaptive mutation is at least one of the replacements of the first said amino acid at the said position of SEQ ID NO: 6 by the following said amino acid selected from the group consisting of V787A, Q1247L, K1398Q, R1408W, D1431N and E1699G.

Another embodiment of the present invention relates said adaptive mutation is a replacement of V in position 787 of SEQ ID NO: 6 with A.

Another embodiment of the present invention relates said adaptive mutation is a replacement of Q in position 1247 of SEQ ID NO: 6 with L.

Another embodiment of the present invention relates said adaptive mutation is a replacement of K in position 1398 of SEQ ID NO: 6 with Q.

Another embodiment of the present invention relates said adaptive mutation is a replacement of R in position 1408 of SEQ ID NO: 6 with W.

Another embodiment of the present invention relates said adaptive mutation is a replacement of D in position 1431 of SEQ ID NO: 6 with N.

Another embodiment of the present invention relates said adaptive mutation is a replacement of E in position 1699 of SEQ ID NO: 6 with G.

Another embodiment of the present invention relates said adaptive mutation is a replacement of A in position 1739 of SEQ ID NO: 6 with V.

Another embodiment of the present invention relates said adaptive mutation is a replacement of S in position 2100 of SEQ ID NO: 6 with T.

Another embodiment of the present invention relates said adaptive mutation is a replacement of V in position 2170 of SEQ ID NO: 6 with A.

Another embodiment of the present invention relates said adaptive mutation is a replacement of I in position 2266 of SEQ ID NO: 6 with T.

One embodiment of the present invention relates to adaptive mutations, wherein said adaptive mutation is at least one of the replacements of the first said amino acid at the said position of SEQ ID NO 78 by the following said amino acid selected from the group consisting of T794S, W845R, T1096A, K1405Q, A2287P and T2327A.

One embodiment of the present invention relates to adaptive mutations, wherein said adaptive mutation is at least one of the replacements of the first said amino acid at the said position of SEQ ID NO: 78 by the following said amino acid selected from the group consisting of W845R, T1096A, K1405Q and T2327A.

One embodiment of the present invention relates to adaptive mutations, wherein said adaptive mutation is at least one of the replacements of the first said amino acid at the said position of SEQ ID NO: 78 by the following said amino acid selected from the group consisting of T1096A.

Another embodiment of the present invention relates said adaptive mutation is a replacement of T in position 794 of SEQ ID NO: 78 with S.

Another embodiment of the present invention relates said adaptive mutation is a replacement of W in position 845 of SEQ ID NO: 78 with R.

Another embodiment of the present invention relates said adaptive mutation is a replacement of T in position 1096 of SEQ ID NO: 78 with A.

Another embodiment of the present invention relates said adaptive mutation is a replacement of K in position 1405 of SEQ ID NO: 78 with Q.

Another embodiment of the present invention relates said adaptive mutation is a replacement of A in position 2287 of SEQ ID NO: 78 with P.

Another embodiment of the present invention relates said adaptive mutation is a replacement of T in position 2327 of SEQ ID NO: 78 with A.

Transfer of adaptive mutations across isolates, subtypes and genotypes.

Cell culture systems expressing Core-NS2 of the 7 major HCV genotypes were developed based on the unique replication capacity of the JFH1 genotype 2a isolate. As all systems, except for genotype 2, were adapted by acquisition of mutations, the present inventors analyzed the ability of single adaptive mutations to confer adaptation across isolates, subtypes and major genotypes.

To first test whether mutations conferred adaptation to other isolates within the same subtype, the present inventors constructed JFH1-based recombinants of additional 1a (TN, GenBank accession number EF621489) and 3a (DBN) isolates and investigated whether cell culture adaptation could be achieved by previously identified 1a and 3a adaptive mutations, respectively.

To further analyze adaptation across subtypes and genotypes, the present inventors focused on several mutations, many of which had been observed for genotype 1 recombinants described by the present invention; a number of NS3 mutations and one NS5A mutation. Each was originally observed in the JFH1 sequence during adaptation analysis. Mutations were analyzed for 1a, 1b, 3a and 4a JFH1-based recombinants.

In the cross-isolate analysis disclosed in Example 4 and 6, introduction of NS3 or p7/NS3 adaptive mutations observed for the original H77/JFH1 and S52/JFH1 viruses, into the alternative 1a and 3a isolates (TN and DBN) yielded relatively high infectivity titers. Introduced mutations could produce a genetically stable and efficient 1a recombinant. The 3a recombinant was as well adapted by the introduced mutations, however it also adapted further. Interestingly, the partially adapted TN/JFH1(D1431N) in addition acquired K1398Q, that was also shown to adapt other isolates. An observation that underlines the potential of using certain adaptive mutation to adapt other JFH1-based intergenotypic recombinants.

To test various adaptive mutations and combinations thereof, the following constructs were made, and found to efficiently produce infectious viral particles in culture after transfection (Table 11): DBN/JFH1 T1096A, DBN/JFH1 T1096A, T2327A, and pDBN/JFH1 W845R,K1405Q (FIGS. 23B and 24B, SEQ ID NOs: 85, 87 and 88 and deduced amino acid sequences SEQ ID NOs: 93, 95 and 96). The following constructs were made, and found to efficiently produce infectious viral particles in culture after transfection but however required further adaptation (Table 11): DBN/JFH1 (K1405Q), DBN/JFH1(T794S, K1405Q) and pDBN/JFH1 T2327A; (SEQ ID NO: 75 and 76 and 86 and deduced amino acid sequences 79, 80 and 94).

When sequencing HCV genomes from the supernatant of DBN/JFH1 infected cell cultures, the following changes at the nucleotide level were observed at least once; C1619T, C2721G, T2873A, T2873C, A3626G, A4553C, C5326T, C5728T, G7199C and A7319G.

These mutations caused the amino acid changes T794S, W845R, T1096A, K1405Q, A2287P and T2327A.

Replacement of previously found adaptive mutations by the NS3 mutations analysed in the cross-genotype and -subtype analysis disclosed in Example 4 and resulted in kinetics comparably slower than for the optimally adapted recombinants for H77/JFH1, J4/JFH1 and S52/JFH1, though still markedly better than for the un-adapted viruses. Compared to the tested NS3 mutations, the NS5A mutation yielded similar kinetics for 3a/JFH1 but slower kinetics for other genotypes. While genetically stable and efficient genotype 1 recombinants where achieved only after introduction of certain mutations, this was the case for all tested mutations for S52/JFH1. ED43/JFH1 (4a/JFH1) was not adapted by any of the tested mutations.

In conclusion, while adaptive mutations in some cases were specific for the intergenotypic recombinant in which they were originally observed, in other cases introduction of single mutations yielded efficient and genetically stable recombinants across isolates within the same subtype as well as across major genotypes. Thus, these experiments clearly show that adaptive mutations identified by the present inventors for HCV cell culture systems of different genotypes have potential use in adapting other isolates with the same subtype, other subtypes within the same genotype and other HCV genotypes that the isolate for which the mutation was first identified.

Thus, the results disclosed in Example 4 and 6, surprisingly shows that adaptive mutations identified in one isolate can confer viability to another isolate of the same subtype. In addition it was showed that adaptive mutations identified in one subtype can confer viability to another subtype of the same genotype. Furthermore it was shown that that some adaptive mutations identified in one genotype can confer viability to another genotype.

Thus, in one embodiment the present invention relates to the transfer of adaptive mutations previously and presently identified for one isolate to another isolate of the same subtype.

In another embodiment the present invention relates to the transfer of adaptive mutations previously and presently identified for one subtype to another subtype of the same genotype.

In a further embodiment the present invention relates to the transfer of adaptive mutations previously and presently identified for one genotype to another genotype.

In the present context the term "genotype" is to be understood in accordance with Simmonds et al. 2005—i.e. the term "genotype" relate to the presently 7 identified major HCV genotypes. The terms "genotype" and "major genotype" are used herein interchangeably.

In the present context the term "subtype" is to be understood in accordance with Simmonds et al. 2005—in relation to genotype 1, this means the presently identified subtypes indicated by lower-case letters; 1a, 1b, 1c etc. (Simmonds et al. 2005).

In the present context the term "isolate" is to be understood in accordance with Simmonds et al. 2005—in relation to subtype 1a this means for example H77C and TN whereas it in relations to 1b means for example J4. Several different isolates/strains exist within the same subtype. The terms "isolate" and "strain" are used herein interchangeably.

In an embodiment the present invention pertains to a method to increase the infectivity titer, said method comprising the steps of:
(i) identifying one or more adaptive mutation(s) in one isolate, subtype or genotype
(ii) transferring said adaptive mutation(s) to an isolate, subtype or genotype different from the isolate, subtype or genotype in step (i)
(iii) determining the infectivity titer in the isolate, subtype or genotype in step (ii)
(iv) determining a reference level by determining the infectivity titer in the wild type construct without the given adaptive mutation(s)
(v) comparing the determined infectivity titer with the reference level
(vi) determining the infectivity titer as increased if the determined infectivity titer is at or above the reference level.

Titer

To determine the efficiency of the developed system, HCV RNA titers are determined in IU/ml (international units/ml) with Taq-Man Real-Time-PCR and infectious titers are determined with a tissue culture infectious dose −50 method. This titer shows the dilution of the examined viral stock, at which 50% of the replicate cell cultures used in the essay become infected and is given in $TCID_{50}$/ml. Alternatively the infectious titers are determined as FFU/ml (focus forming units/ml); in this method, infectivity titers are determined by infection of cell culture replicates with serial dilutions of virus containing supernatants and, following immuno-stainings for HCV antigens, counting of HCV-antigen positive cell foci.

HCV RNA titers and infectivity titers can be determined extracellularly, in cell culture supernatant (given as IU and $TCID_{50}$ or FFU per ml, respectively) or intracellularly, in lysates of pelleted cells (given as IU and $TCID_{50}$ or FFU related to a given cell number, which was lysed).

One embodiment of the present invention relates to a nucleic acid molecule of the present invention, wherein said molecule is capable of generating a HCV RNA titer of $10^4$ IU/ml or above following transfection and/or subsequent viral passage, such as a titer of at least $10^5$ IU/mL, such as a titer of at least $10^6$ IU/mL, such as a titer of at least $10^7$ IU/mL, such as a titer of at least $10^8$ IU/mL, such as a titer of at least $10^9$ IU/mL, such as a titer of at least $10^{10}$ IU/mL, such as a titer of at least $10^{11}$ IU/mL, or such as a titer of at least $10^{12}$ IU/mL.

In another embodiment, the present invention relates to a nucleic acid molecule according to the invention, wherein said molecule is capable of generating a HCV infectivity titer of at least $10^2$ $TCID_{50}$/ml or above following transfection and/or subsequent viral passage, such as a titer of at least $10^3$ TCID50/ml, such as a titer of at least $10^4$ $TCID_{50}$/ml, such as a titer of at least $10^5$ $TCID_{50}$/ml, such as a titer of at least $10^6$ $TCID_{50}$/ml, such as a titer of at least $10^7$ $TCID_{50}$/ml, such as a titer of at least $10^8$ $TCID_{50}$/ml, such as a titer of at least $10^9$ $TCID_{50}$/ml or such as a titer of at least $10^{10}$ $TCID_{50}$/ml.

It is of course evident to the skilled addressee that the titers described here is obtained using the assay described in this text. Any similar or equivalent titer determined by any method is thus evidently within the scope of the present invention.

Compositions

One embodiment of the present invention relates to a composition comprising a nucleic acid molecule according to the invention suspended in a suitable amount of a pharmaceutical acceptable diluent or excipient.

In another embodiment, this invention provides for compositions comprising an isolated nucleic acid, vector or cell of this invention, or an isolated nucleic acid obtained via the methods of this invention.

In one embodiment, the term "composition" refers to any such composition suitable for administration to a subject, and such compositions may comprise a pharmaceutically acceptable carrier or diluent, for any of the indications or modes of administration as described. The active materials in the compositions of this invention can be administered by any appropriate route, for example, orally, parenterally, intravenously, intradermally, subcutaneously, or topically, in liquid or solid form.

It is to be understood that any applicable drug delivery system may be used with the compositions and/or agents/ vectors/cells/nucleic acids of this invention, for administration to a subject, and is to be considered as part of this invention.

The compositions of the invention can be administered as conventional HCV therapeutics. The compositions of the invention may include more than one active ingredient which interrupts or otherwise alters groove formation, or occupancy by RNA or other cellular host factors, in one embodiment, or replicase components, in another embodiment, or zinc incorporation, in another embodiment.

The precise formulations and modes of administration of the compositions of the invention will depend on the nature of the anti-HCV agent, the condition of the subject, and the judgment of the practitioner. Design of such administration and formulation is routine optimization generally carried out without difficulty by the practitioner.

It is to be understood that any of the methods of this invention, whereby a nucleic acid, vector or cell of this invention is used, may also employ a composition comprising the same as herein described, and is to be considered as part of this invention.

"Pharmaceutically acceptable" refers to molecular entities and compositions that are physiologically tolerable and do not typically produce an allergic or similar untoward reaction, such as gastric upset, dizziness and the like, when administered to a human. Preferably, as used herein, the term "pharmaceutically acceptable" means approved by a regulatory agency of the Federal or a state government or listed in the U.S. Pharmacopoeia or other generally recognized pharmacopoeia for use in animals, and more particularly in humans.

The term "excipient" refers to a diluent, adjuvant, carrier, or vehicle with which the compound is administered. Such pharmaceutical carriers can be sterile liquids, such as water and oils, including those of petroleum, animal, vegetable or synthetic origin, such as peanut oil, soybean oil, mineral oil, sesame oil and the like. Water or aqueous solution saline solutions and aqueous dextrose and glycerol solutions are preferably employed as carriers, particularly for injectable solutions. Suitable pharmaceutical carriers are described in "Remington's Pharmaceutical Sciences" by E. W. Martin.

The term "adjuvant" refers to a compound or mixture that enhances the immune response to an antigen. An adjuvant can serve as a tissue depot that slowly releases the antigen and also as a lymphoid system activator that non-specifically enhances the immune response. Often, a primary challenge with an antigen alone, in the absence of an adjuvant, will fail to elicit a humoral or cellular immune response. Adjuvants include, but are not limited to, complete Freund's adjuvant, incomplete Freund's adjuvant, saponin, mineral gels such as aluminum hydroxide, surface active substances such as lysolecithin, pluronic polyols, polyanions, peptides, oil or hydrocarbon emulsions, keyhole limpet hemocyanins, dinitrophenol, and potentially useful human adjuvants such as BCG (bacille Calmette-Guerin) and *Corynebacterium parvmm*. Preferably, the adjuvant is pharmaceutically acceptable.

Cells

The nucleotides of the present invention may be used to provide a method for identifying additional cell lines that are permissive for infection with HCV, comprising contacting (e.g. transfecting) a cell line in tissue culture with an infectious amount of HCV RNA of the present invention, e.g., as produced from the plasmid clones, and detecting replication and formation and release of viral particles of HCV in cells of the cell line.

Naturally, the invention extends as well to a method for identifying an animal that is permissive for infection with HCV, comprising introducing an infectious amount of the HCV RNA, e.g., as produced by the plasmids, to the animal, and detecting replication and formation and release of viral particles of HCV in the animal. By providing infectious HCV, e.g. comprising a dominant selectable marker, the invention further provides a method for selecting for HCV with further adaptive mutations that permit higher levels of HCV replication in a permissive cell line or animal comprising contacting (e.g. transfecting) a cell line in culture, or introducing into an animal, an infectious amount of the HCV RNA, and detecting progressively increasing levels of HCV RNA and infectious HCV viral particles in the cell line or the animal.

In a specific embodiment, the adaptive mutation permits modification of HCV tropism. An immediate implication of this aspect of the invention is creation of new valid cell culture and animal models for HCV infection.

The permissive cell lines or animals that are identified using the nucleic acids of the invention are very useful, inter alia, for studying the natural history of HCV infection, isolating functional components of HCV, and for sensitive, fast diagnostic applications, in addition to producing authentic HCV virus or components thereof.

Because the HCV DNA, e.g., plasmid vectors, of the invention encode HCV components, expression of such vectors in a host cell line transfected, transformed, or transduced with the HCV DNA can be effected.

For example, a baculovirus or plant expression system can be used to express HCV virus particles or components thereof. Thus, a host cell line may be selected from the group consisting of a bacterial cell, a yeast cell, a plant cell, an insect cell, and a mammalian cell.

In one embodiment, the cell is a hepatocyte, or in another embodiment, the cell is the Huh-7 hepatoma cell line or a derived cell line such as Huh7.5, Huh7.5.1 cell line.

In one embodiment, the cell, or in another embodiment, cell systems of this invention comprise primary cultures or other, also non hepatic cell lines. "Primary cultures" refers, in one embodiment, to a culture of cells that is directly derived from cells or tissues from an individual, as well as cells derived by passage from these cells, or immortalized cells.

In one embodiment, "cell line" refers to a population of cells capable of continuous or prolonged growth and division in vitro. The term "cell lines" also includes immortalized cells. Often, cell lines are clonal populations derived from a single progenitor cell. Such cell lines are also termed "cell clones". It is further known in the art that spontaneous or induced changes can occur in karyotype during storage or transfer of such clonal populations. Therefore, cells derived from the cell clones referred to may not be precisely identical to the ancestral cells or cultures. According to the present invention, such cell clones may be capable of supporting replication of a vector, virus, viral particle, etc., of this invention, without a significant decrease in their growth properties, and are to be considered as part of this invention.

It is to be understood that any cell of any organism that is susceptible to infection by or propagation of an HCV construct, virus or viral particle of this invention is to be considered as part of this invention, and may be used in any method of this invention, such as for screening or other assays, as described herein.

Thus in one embodiment the present invention relates to a method for producing a cell which replicates HCV 1a/JFH1 RNA and/or 1b/JFH1 RNA and produces a virus particle comprising introducing the said RNA according to the invention into a cell.

In another embodiment the present invention relates to a method for producing a cell which replicates HCV 3a/JFH1 RNA and produces a virus particle comprising introducing the said RNA according to the invention into a cell.

In one embodiment the 1a strain is H77C or TN and the 1b strain is J4.

In another embodiment the 3a strain is DBN.

In a further embodiment the present invention pertains to a method for producing a cell, which replicates an RNA comprising the structural genes (Core, E1, E2), p7 and the non-structural gene NS2 of genotype 1a strain H77C or TN or 1b strain J4 or 3a strain DBN and the non-structural genes NS3, NS4A, NS4B, NS5A and NS5B from the JFH1 strain and produces a virus particle comprising introducing the said RNA into a cell wherein said RNA encodes an amino acid sequence comprising one or more adaptive mutations.

Also, a method for in vitro producing a hepatitis C virus-infected cell comprising culturing the cell which produces virus particles of the present invention and infecting other cells with the produced virus particle in the culture.

Naturally, the invention extends to any cell obtainable by such methods, for example any in vitro cell line infected with HCV, wherein the HCV has a genomic RNA sequence as described herein. Such as a hepatitis C virus infected cell obtainable by any of the methods described.

In one embodiment, the cell line is a hepatocyte cell line such as Huh7 or derived cell lines e.g. Huh7.5 or Huh7.5.1.

In another embodiment the cell is Huh7.5.

In another embodiment the cell is any cell expressing the genes necessary for HCV infection and replication, such as but not limited to CD81, SR-BI, Claudin-1, −4, −6 or −9 and the low-density lipid receptor.

Importance of CD81 for HCV entry has in previous studies been shown for pseudoviral particles (HCVpp) of genotypes 1-6, and for cell culture derived HCV (HCVcc) of genotypes 1a (H77), 1b (Con-1), 3a (S52), 4a (ED43) and 5a (SA13). Blocking of SR-BI receptors was found to inhibit infection with HCVpp of genotypes 1-6. In the HCVcc system, genotypes 2a and 5a in previous studies depended on SR-BI. In comparative studies, the present investigators showed that entry of genotypes 1, 2 and 6 was efficiently inhibited when relative high doses of blocking antibodies against the respective HCV co-receptor were used (FIG. 14). Thus, CD81 and SR-BI play an important role for entry of prototype isolates of the six major genotypes and important subtypes 1b and 2b. Future studies will be required to determine if the different levels of inhibition seen at lower antibody doses are due to stochastical effects or indicate different modes of entry.

The invention further provides various methods for producing HCV virus particles, including by isolating HCV virus particles from the HCV-infected non-human animal of invention; culturing a cell line of the invention under conditions that permit HCV replication and virus particle formation; or culturing a host expression cell line transfected with HCV DNA under conditions that permit expression of HCV particle proteins; and isolating HCV particles or particle proteins from the cell culture. The present invention extends to an HCV virus particle comprising a replication-competent HCV genome RNA, or a replication-defective HCV genome RNA, corresponding to an HCV nucleic acid of the invention as well.

Virus Particle

The production of authentic virus proteins (antigens) may be used for the development and/or evaluation of diagnostics. The cell culture system according to the invention also allows the expression of HCV antigens in cell cultures. In principle these antigens can be used as the basis for diagnostic detection methods.

The production of HCV viruses and virus-like particles, in particular for the development or production of therapeutics and vaccines as well as for diagnostic purposes is an embodiment of the present invention. Especially cell culture adapted complete HCV genomes, which could be produced by using the cell culture system according to the invention, are able to replicate and form viral particles in cell culture with high efficiency. These genomes have the complete functions of HCV and in consequence they are able to produce infectious viruses.

Thus in one embodiment the present invention relates to a method for producing a hepatitis C virus particle of the present invention or parts thereof, comprising culturing a cell or an animal to allow either to produce the virus.

In another embodiment the inventions provides a hepatitis C virus particle obtainable by the method described.

Because the invention provides, inter alia, infectious HCV RNA, the invention provides a method for infecting an animal with HCV which comprises administering an infectious dose of HCV RNA, such as the HCV RNA transcribed from the plasmids described above, to the animal. Naturally, the invention provides a non-human animal infected with HCV of the invention, which non-human animal can be prepared by the foregoing methods.

A further advantage of the present invention is that, by providing a complete functional HCV genome, authentic HCV viral particles or components thereof, which may be produced with native HCV proteins or RNA in a way that is not possible in subunit expression systems, can be prepared.

In addition, since each component of HCV of the invention is functional (thus yielding the authentic HCV), any specific HCV component is an authentic component, i.e., lacking any errors that may, at least in part, affect the clones of the prior art. Indeed, a further advantage of the invention is the ability to generate HCV virus particles or virus particle proteins that are structurally identical to or closely related to natural HCV virions or proteins. Thus, in a further embodiment, the invention provides a method for propagating HCV in vitro comprising culturing a cell line contacted with an infectious amount of HCV RNA of the invention, e.g., HCV RNA translated from the plasmids described above, under conditions that permit replication of the HCV RNA.

Further the viability of the developed viruses may be determined in vivo, either in SCID-uPA mice engrafted with human liver tissue or in chimpanzees as shown in Lindenbach et al. 2006.

In one embodiment, the method further comprises isolating infectious HCV. In another embodiment, the method further comprises freezing aliquots of said infectious HCV. According to this aspect of the invention, and in one embodiment, the HCV is infectious following thawing of said aliquots, and in another embodiment, the HCV is infectious following repeated freeze-thaw cycles of said aliquots.

Screening for anti-viral drugs and the determination of drug resistance

It can be assumed that resistance to therapy occurs due to the high mutation rate of the HCV genome. This resistance, which is very important for the clinical approval of a substance, can be detected with the cell culture system according to the invention. Cell lines, in which the HCV-RNA construct or the HCV genome or subgenome replicates and produces infectious viral particles, are incubated with increasing concentrations of the relevant substance and the replication of the viral RNA is either determined by means of an introduced reporter gene or through the qualitative or quantitative detection of the viral nucleic acids or proteins. The release of viral particles is determined by measuring HCV RNA and infectivity titers in the cell culture supernatant. Resistance is given if no or a reduced inhibition of the replication and release of viral particles can be observed with the normal concentration of the active substance. The nucleotide and amino acid replacements responsible for the therapy resistance can be determined by recloning the HCV-RNA (for example by the means of RT-PCR) and sequence analysis. By cloning the relevant replacement(s) into the original construct its causality for the resistance to therapy can be proven.

While the replicon systems facilitated testing of drugs interfering with replication such as NS3/4A protease and polymerase inhibitors, the variant genomes obtained in the present invention may prove useful for different research topics. Genomes with the original H77C, TN, J4 or DBN Core could be applied to examine genotype 1a and 1b specific features of Core.

The systems developed in this invention are ideal candidates for genotype 1a and/or 1b and/or 3a specific testing of therapeutics in general and therapeutics targeting viral entry, assembly and release. Genomes with the H77C, TN, J4 or DBN sequences is valuable for testing of neutralizing antibodies and other drugs acting on entry level, such as fusion inhibitors.

The present inventors conducted cross-genotype neutralization studies in HCV cell culture systems recapitulating the entire viral life cycle using JFH1-based viruses with envelope sequences of all 7 major genotypes and the important subtypes 1b and 2b, which has previously not been possible (Table 3). HCV E1/E2 assembled on HCV pseudo particles (HCVpp), used in previous neutralization studies could show an unphysiological confirmation, glycosylation pattern and/or lipoprotein association due to the nature of the HCVpp as well as the non-hepatic producer cell-lines used in such experiments.

In such studies the viral particles are incubated with the neutralizing substance, e.g. patient derived antibodies present in serum, prior to incubation with cells permissive and susceptible to viral infection. The neutralizing effect, i.e. the inhibitory effect on viral entry, is measured e.g. by relating the number of focus forming units (FFUs, defined as foci of adjacent infected cells) to the equivalent count in a control experiment done under same circumstances without the active inhibitor molecule.

Figure 5:
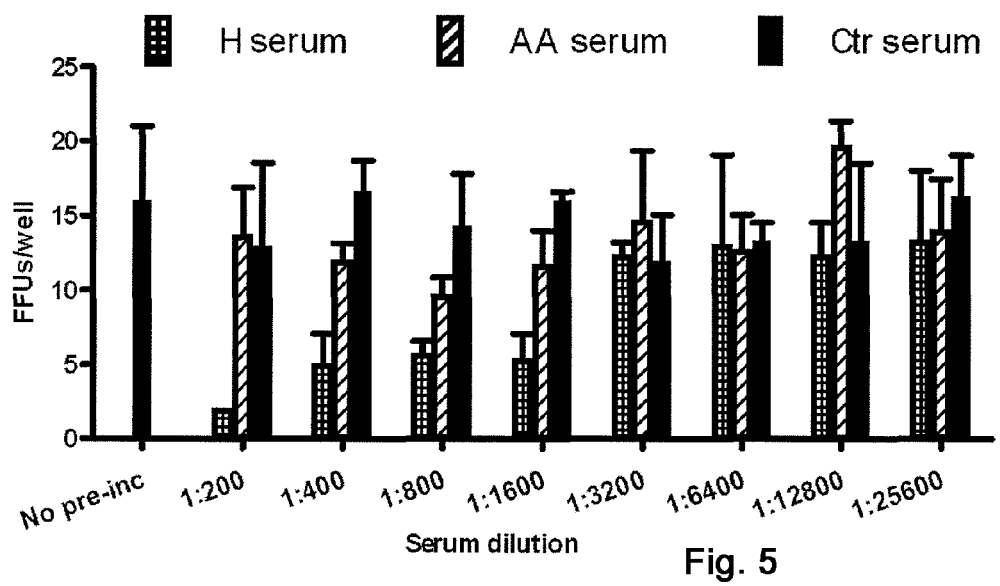

The inventors of the present invention showed that JFH1-based viruses of genotype 1a, 1b, 2b, 4a, 5a, 6a and 7a were efficiently neutralized by chronic phase H06 genotype 1a serum derived from reference Patient H (FIG. 5 and Table 3). Neutralization of the ancestral H77C/JFH1 virus, whose sequence originates from acute phase Patient H serum, is in agreement with an extensive longitudinal study on neutralizing antibodies in Patient H carried out in the HCVpp system showing neutralization by serum samples taken later but not concurrently or earlier than the envelope sequence used for HCVpp. The results in the cell culture systems compare well to neutralization experiments using Patient H serum from year 26 (H03) carried out in HCVpp systems with envelope proteins of the same prototype isolates of all 6 HCV genotypes as used in the present application, and heterogeneity between the genotypes is thus as previously reported.

In addition the present inventors found that cross-genotype neutralization extended to a chronic phase genotype 4a serum (AA), which efficiently neutralized genotype 2b, 4a, 5a, 6a and 7a and to a lesser extent 1a (FIG. 5 and Table 3). Also, the cross-genotype neutralization extended to a chronic phase genotype 5a serum (SA3), which efficiently neutralized genotype 2b, 4a, 5a, 6a and 7a (Table 3). It is of note that genotypes subtypes 2a and 2b, which belong to the same genotype and genotypes 2b and 7a, which have, for isolates of different major genotypes, a relatively high sequence homology, differ in their susceptibility to neutralization.

Accordingly, the JFH1-based cell culture systems which has been developed for HCV genotype 1a/1b, 2a/2b, 3a, 4a, 5a, 6a and 7a provides a valuable tool for efficiently screening for and identifying new candidate HCV genotype 1a/1b, 2a/2b, 3a, 4a, 5a, 6a and 7a inhibitors e.g. of entry e.g. in serum derived from infected patients. Accordingly this invention, allows identification and raise of cross-neutralizing antibodies, which is important for the development of active and passive immunization strategies. Furthermore the availability of cell culture grown HCV particles bearing envelope proteins of the six major genotypes enables the development of inactivated whole virus vaccines and comprehensive virus neutralization studies.

In one embodiment the present invention relates to a method for identifying neutralizing antibodies.

In another one embodiment the present invention relates to a method for identifying cross-genotype neutralizing antibodies.

In one embodiment the present invention relates to a method of raising neutralizing antibodies.

In another embodiment the present invention relates to a method of raising cross neutralizing antibodies.

In one embodiment the present invention related to a method for screening new HCV genotype 1a/1b, 2a/2b, 3a, 4a, 5a, 6a and/or 7a inhibitors or neutralizing antibodies, comprising
  a) culturing at least one selected from the group consisting of a cell according to the present invention, a hepatitis C virus infected cell according to the present invention and a hepatitis C virus particle obtainable by the present invention together with a hepatitis C virus permissive cell, and
  b) subjecting said virus or virus infected cell culture to a blood sample or derivatives thereof from a HCV genotype 1a/1b, 2a/2b, 3a, 4a, 5a, 6a and/or 7a infected patient
  c) detecting the amount of replicating RNA and/or the virus particles.

The p7 peptide features two transmembrane domains (TM1 and TM2), and p7 monomers multimerize to form a putative ion channel. Additionally p7 has been shown to contain genotype specific sequences required for genotype specific interactions between p7 and other HCV proteins. Hence, new compounds targeting the putative p7 ion-channel and autoprotease inhibitors interfering with NS2, and drugs targeting cellular proteins involved in the described processes can be tested.

Figure 15:
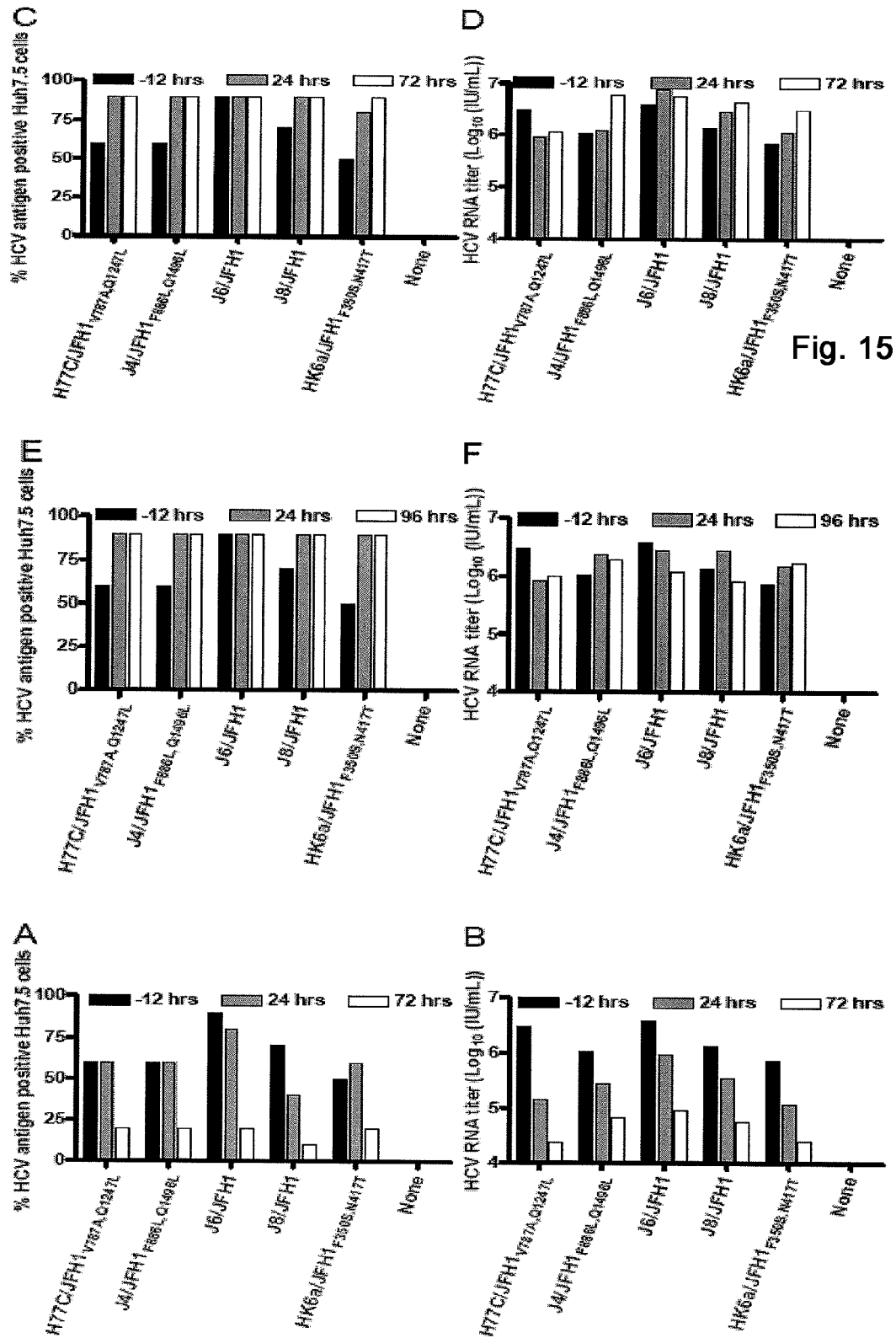

The inventors of the present invention showed that JFH1-based viruses can be used for testing putative anti-HCV antivirals. Huh7.5 cultures infected with JFH1-based recombinants of genotypes 1a, 1b, 2a, 2b, and 6a were treated with 500 IU/mL interferon-α2b (FIG. 15 A,B), 20 µM ribavirin (FIG. 15 C, D) or 50 µM amantadine (FIG. 15 E, F), respectively. A combination of interferon-α2b and ribavirin is the only currently licensed treatment of HCV infected patients. While sustained viral response (SVR) can be achieved in 80-90% of genotype 2 and 3 infected patients treated with this combination therapy, SVR is only seen in 40-50% of genotype 1 and 4 infected patients. Sequence differences of several genome regions, especially E2 and NS5A, are suggested to be responsible for this differential response. The ion-channel blocker amantadine is used in treatment of influenza and has been suggested to block HCV p7. At the tested concentrations, no significant cytotoxic effect was observed. After 72 hrs of interferon-α2b treatment, an >60% decrease in the number of infected cells and a ~2 log decrease in supernatant HCV RNA titers was observed (FIG. 15 A, B). Treatment with ribavirin and amantadine had no apparent effect (FIGS. 15 C-F). This is in line with previous studies, in which interferon decreased replication of J6/JFH, whereas ribavirin and amantadine did not decrease production of infectious virus in JFH1 cultures or cultures with genotype 1a (H77), 1b (Con1) or 2a (J6) JFH1-based recombinants. Genotype specific susceptibility to interferon-α2 in patients was attributed different genome regions, especially in E2 and NS5A. With the relatively high doses used for treatment of genotype 1-6 infected cultures, we did not observe any genotype specific effect; in future studies, it will be of interest to test different interferon doses and different HCV isolates, preferably from patients showing different responses to interferon. Differential sensitivity to interferon could also be mediated by the UTRs or NS3 to NS5B proteins, which are genotype 2a specific in all the recombinants tested. In conclusion, the developed systems can be applied to test the antiviral potential of known and newly developed therapeutics and to test, which HCV genome regions mediated resistance to treatment.

Thus, one embodiment of the present invention relates to a method for screening an anti-hepatitis C virus substance, comprising
 a) culturing at least one selected from the group consisting of a cell according to the present invention, a hepatitis C virus infected cell according to the present invention and a hepatitis C virus particle obtainable by the present invention together with a hepatitis C virus permissive cell, and
 b) detecting the replicating RNA and/or the virus particles in the resulting culture.

Thus, one embodiment of the present invention relates to a method for screening an anti-hepatitis C virus substance, comprising
 a) culturing at least one selected from the group consisting of a cell according to the present invention, a hepatitis C virus infected cell according to the present invention and a hepatitis C virus particle obtainable by the present invention together with a hepatitis C virus permissive cell, and
 b) subjecting said virus or virus infected cell culture to the anti-hepatitis C virus substance, and
 c) detecting the replicating RNA and/or the virus particles in the resulting culture.

The skilled addressee may use the present invention to determine whether the identified sets of mutations can confer viability to other JFH1 based intergenotypic genotype 1a and 1b recombinants, which would allow in vitro studies of any patient genotype 1 isolate of interest.

Finally, it would be interesting to elucidate the mechanism of action of the identified mutations. In principle they might enable efficient intergenotypic protein interaction and/or lead to improvement of protein function independent of these intergenotypic interactions, for example by influencing interactions with host cell proteins.

In another embodiment, the inhibition of HCV replication and/or infection and/or pathogenesis includes inhibition of downstream effects of HCV. In one embodiment, downstream effects include neoplastic disease, including, in one embodiment, the development of hepatocellular carcinoma.

In one embodiment, the invention provides a method of screening for anti-HCV therapeutics, the method comprising contacting a cell with an isolated nucleic acid molecule encoding an infectious recombinant HCV genome, comprising a chimeric HCV genome and contacting the cell with a candidate molecule, independently contacting the cell with a placebo and determining the effects of the candidate molecule on HCV infection, replication, or cell-to-cell spread, versus the effects of the placebo, wherein a decrease in the level of HCV infection, replication, or cell-to-cell spread indicates the candidate molecule is an anti-HCV therapeutic.

In one embodiment, the method may be conducted be in vitro or in vivo. In one embodiment, the cells as described may be in an animal model, or a human subject, entered in a clinical trial to evaluate the efficacy of a candidate molecule.

In one embodiment, the molecule is labelled for easier detection, including radio-labelled, antibody labelled for fluorescently labelled molecules, which may be detected by any means well known to one skilled in the art.

In one embodiment, the candidate molecule is an antibody.

In one embodiment, the term "antibody" refers to intact molecules as well as functional fragments thereof, such as Fab, F(ab')2, and Fv. In one embodiment, the term "Fab" refers to a fragment, which contains a monovalent antigen-binding fragment of an antibody molecule, and in one embodiment, can be produced by digestion of whole antibody with the enzyme papain to yield an intact light chain and a portion of one heavy chain, or in another embodiment can be obtained by treating whole antibody with pepsin, followed by reduction, to yield an intact light chain and a portion of the heavy chain. In one embodiment, the term "F(ab')2", refers to the fragment of the antibody that can be obtained by treating whole antibody with the enzyme pepsin without subsequent reduction, F(ab')2 is a dimer of two Fab' fragments held together by two disulfide bonds. In another embodiment, the term "Fv" refers to a genetically engineered fragment containing the variable region of the light chain and the variable region of the heavy chain expressed as two chains, and in another embodiment, the term "single chain antibody" or "SCA" refers to a genetically engineered molecule containing the variable region of the light chain and the variable region of the heavy chain, linked by a suitable polypeptide linker as a genetically fused single chain molecule.

Methods of producing these fragments are known in the art.

In another embodiment, the candidate molecule is a small molecule. In one embodiment, the phrase "small molecule" refers to, inter-alia, synthetic organic structures typical of pharmaceuticals, peptides, nucleic acids, peptide nucleic acids, carbohydrates, lipids, and others, as will be appreciated by one skilled in the art. In another embodiment, small molecules, may refer to chemically synthesized peptidomimetics of the 6-mer to 9-mer peptides of the invention.

In another embodiment, the candidate molecule is a nucleic acid. Numerous nucleic acid molecules can be envisioned for use in such applications, including antisense, siRNA, ribozymes, etc., as will be appreciated by one skilled in the art.

It is to be understood that the candidate molecule identified and/or evaluated by the methods of this invention, may be any compound, including, inter-alia, a crystal, protein, peptide or nucleic acid, and may comprise an HCV viral product or derivative thereof, of a cellular product or derivative thereof. The candidate molecule in other embodiments, may be isolated, generated synthetically, obtained via translation of sequences subjected to any mutagenesis technique, or obtained via protein evolution techniques, well known to those skilled in the art, each of which represents an embodiment of this invention, and may be used in the methods of this invention, as well.

In one embodiment, the compound identified in the screening methods as described, may be identified by computer modeling techniques, and others, as described herein. Verification of the activity of these compounds may be accomplished by the methods described herein, where, in one embodiment, the test compound demonstrably affects HCV infection, replication and/or pathogenesis in an assay, as described. In one embodiment, the assay is a cell-based assay, which, in one embodiment, makes use of primary isolates, or in another embodiment, cell lines, etc. In one embodiment, the cell is within a homogenate, or in another embodiment, a tissue slice, or in another embodiment, an organ culture. In one embodiment, the cell or tissue is hepatic in origin, or is a derivative thereof. In another embodiment, the cell is a commonly used mammalian cell line, which has been engineered to express key molecules known to be, or in another embodiment, thought to be involved in HCV infection, replication and/or pathogenesis.

In another embodiment, protein, or in another embodiment, peptide or in another embodiment, other inhibitors of the present invention cause inhibition of infection, replication, or pathogenesis of HCV in vitro or, in another embodiment, in vivo when introduced into a host cell containing the virus, and may exhibit, in another embodiment, an IC50 in the range of from about 0.0001 nM to 100 µM in an in vitro assay for at least one step in infection, replication, or pathogenesis of HCV, more preferably from about 0.0001 nM to 75 µM, more preferably from about 0.0001 nM to 50 µM, more preferably from about 0.0001 nM to 25 µM, more preferably from about 0.0001 nM to 10 µM, and even more preferably from about 0.0001 nM to 1 µM.

In another embodiment, the inhibitors of HCV infection, or in another embodiment, replication, or in another embodiment, pathogenesis, may be used, in another embodiment, in ex vivo scenarios, such as, for example, in routine treatment of blood products wherein a possibility of HCV infection exists, when serology shows a lack of HCV infection.

In another embodiment, the anti-HCV therapeutic compounds identified via any of the methods of the present invention can be further characterized using secondary screens in cell cultures and/or susceptible animal models. In one embodiment, a small animal model may be used, such as, for example, a tree shrew *Tupaia belangeri chinensis*. In another embodiment, an animal model may make use of a chimpanzee. Test animals may be treated with the candidate compounds that produced the strongest inhibitory effects in any of the assays/methods of this invention. In another embodiment, the animal models provide a platform for pharmacokinetic and toxicology studies.

Vaccines

The construct according to the invention by itself can also be used for various purposes in all its embodiments. This includes the construction of hepatitis C viruses or HCV-like particles and their production in cell cultures as described.

These HCV or HCV-like particles can be used in particular as vaccine. Thus, one embodiment of the present invention relates to a hepatitis C vaccine comprising a hepatitis C virus particle according to the invention or a part thereof.

In another embodiment, the nucleic acids, vectors, viruses, or viral particles may be further engineered to express a heterologous protein, which, in another embodiment, is mammalian or a derivative thereof, which is useful in combating HCV infection or disease progression. Such proteins may comprise cytokines, growth factors, tumor suppressors, or in one embodiment, may following infection, be expressed predominantly or exclusively on an infected cell surface. According to this aspect of the invention, and in one embodiment, such molecules may include costimulatory molecules, which may serve to enhance immune response to infected cells, or preneoplastic cells, or neoplastic cells, which may have become preneoplastic or neoplastic as a result of HCV infection. In one embodiment, the heterologous sequence encoded in the nucleic acids, vectors, viruses, or viral particles of this invention may be involved in enhanced uptake of a nucleic acids, vectors, viruses, or viral particles, and may specifically target receptors thought to mediate HCV infection.

Further, the present invention relates to a method for producing a hepatitis C virus vaccine comprising using a hepatitis C virus particle according to the invention as an antigen, and naturally any antibody against such hepatitis C virus particle.

Uses

The genotype 1a and 1b and 3a cell culture system developed of the present invention will be a valuable tool to address different research topics. It will allow the genotype specific study of functions of the structural proteins (Core, E1, E2) as well as p7 and NS2 using reverse genetics. While the replicon systems facilitated testing of drugs interfering with replication such as NS3/4A protease and polymerase inhibitors, the system developed in this study is ideal for the genotype 1 or 3 specific testing of new drugs, such as drugs interfering with viral entry, such as fusion inhibitors, as well as assembly and release.

Accordingly the genotype 1a/1b, 2a/2b, 3a, 4a, 5a, 6a and 7a developed cell culture systems allows individual patient targeting. This means that when a new potential therapeutic candidate is discovered it is possible to test this particular candidate or combination of candidates on each of the individual genotypes. Knowing which specific genotype(s) the candidate is functioning towards, it allows an individual treatment of each patient dependent on which specific genotype the patient is infected with. Furthermore these cell culture systems allow the development of antibodies and vaccines targeting individual patients.

In addition new therapeutics targeting the putative p7 ion-channel and protease inhibitors targeting NS2 can be tested specifically for genotype 1 thus allowing individual patient targeting.

As H77C/JFH1, TN/JFH1, J4/JFH1 and DBN/JFH1 viability does not seem to depend on mutations in the envelope glycoproteins, these recombinant viruses will be well suited for screenings for broadly reactive neutralizing antibodies, thus aiding vaccine development.

The replication level of a virus can be determined, in other embodiments, using techniques known in the art, and in other embodiments, as exemplified herein. For example, the genome level can be determined using RT-PCR. To determine the level of a viral protein, one can use techniques including ELISA, immunoprecipitation, immunofluorescence, EIA, RIA, and Western blotting analysis. To determine the replication rate of a virus, one can use the method described in, e.g., Billaud et al., Virology 266 (2000) 180-188.

In one embodiment, the invention provides a method of identifying sequences in HCV associated with HCV pathogenicity, comprising contacting cells with an isolated nucleic acid molecule encoding an infectious recombinant HCV genome, comprising a chimeric HCV genome, contacting cells with an isolated nucleic acid molecule comprising at least one mutation of the chimeric HCV genome, independently culturing the cells and determining HCV infection, replication, or cell-to-cell spread, in cells contacted with the mutant, versus the chimeric HCV, whereby changes in HCV infection, replication, or cell-to-cell spread in cells contacted with the mutant virus shows the mutation is in an HCV sequence associated with HCV pathogenicity.

In one embodiment, the invention provides a method of identifying HCV variants with improved growth in cell culture, the method comprising contacting cells with an isolated nucleic acid molecule encoding an infectious recombinant HCV genome, comprising a chimeric HCV genome contacting cells with an isolated nucleic acid molecule comprising at least one mutation of the chimeric HCV genome, independently culturing the cells and determining HCV infection, replication, or cell-to-cell spread, in cells contacted with the chimeric HCV or the mutated virus, whereby enhanced HCV infection, replication, or cell-to-cell spread in cells contacted with the mutated virus shows that the HCV variant has improved growth in cell culture. In some embodiments, HCV variants are selected for enhanced replication, over a long course of time, in vitro culture systems. According to this aspect of the invention, and in some embodiments, cells contacted with the variants are characterized by reduced infection, as compared to cells contacted with the chimeric HCV.

Figure 16:
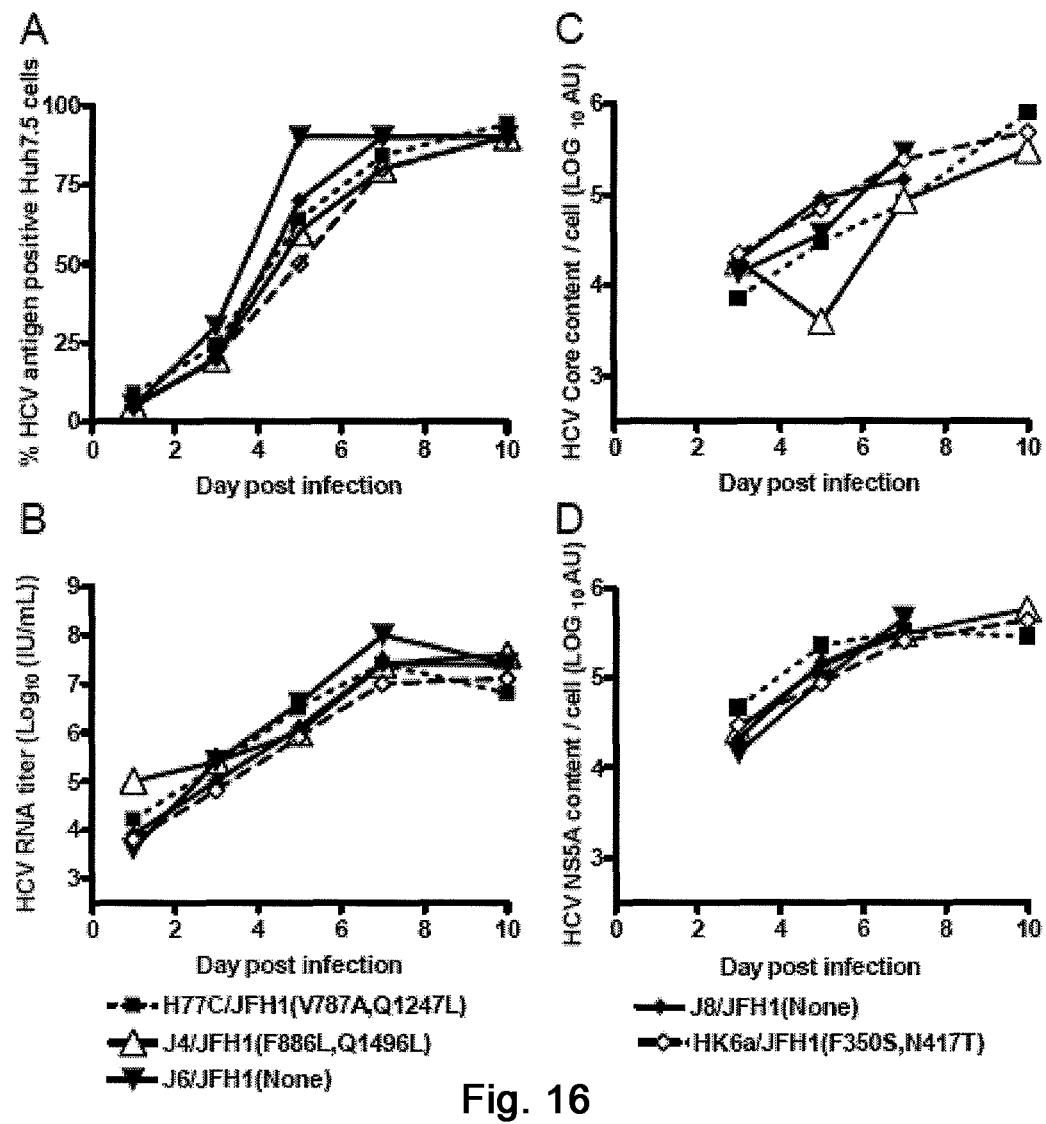

The developed systems can be used to quantify HCV proteins as well as their influence on and interaction with host cell factors. In the present invention, the inventors used confocal microscopy based image analysis to quantify HCV Core and NS5A protein, the amount of intracellular lipids and interaction of Core and NS5A with intracellular lipids. The inventors evaluated spread of in vitro HCV infection by quantitative confocal microscopy based imaging. In a blinded study, increasing amounts of Core and NS5A relative to the number of total cells were detected during days 3-10 for genotype 1, 2 and 6 recombinants (FIGS. 16 C, D), suggesting that this methodology could be an effective tool to evaluate HCV infection in vitro. The method also readily detected a nonspecific background staining with the anti-Core antibody, whereas the anti-NS5A gave no such signal. Thus, for optimization this quantification method requires attention to the selection of antibodies for immunostaining.

Figure 17:
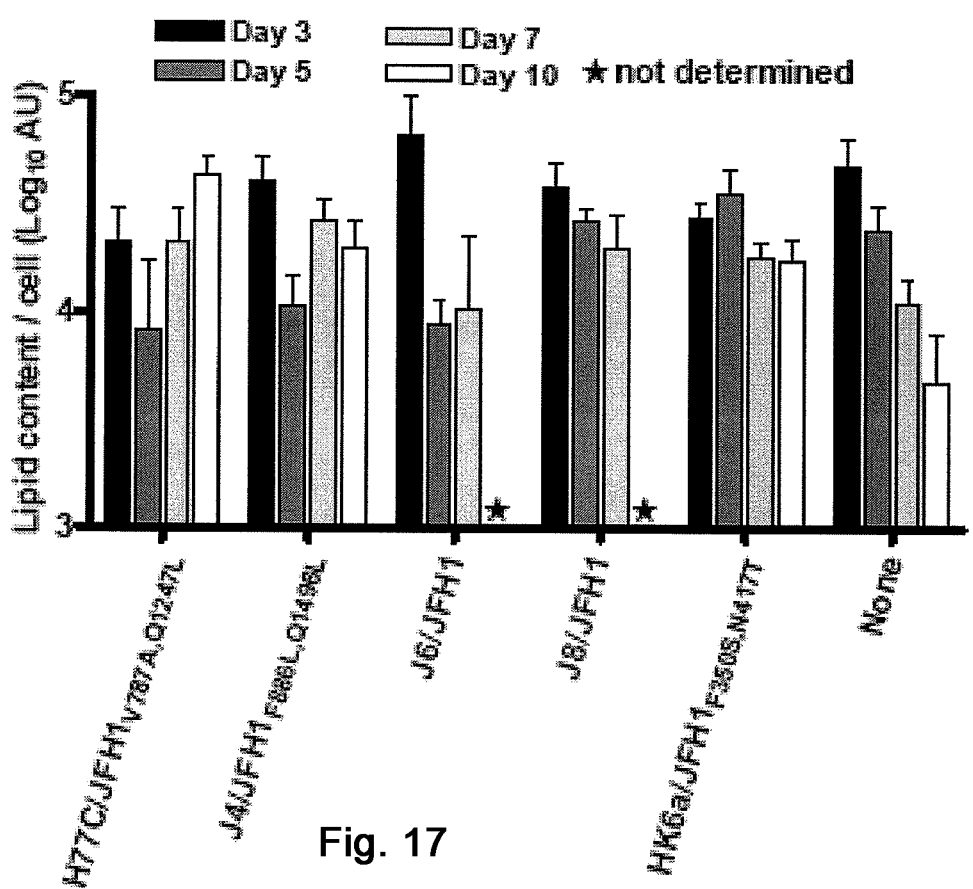

The HCV lifecycle depends on the lipid metabolism and Core has been suspected to induce hepatocellular steatosis in genotype 3 patients. In the present invention, big variation in the lipid content of non-infected Huh7.5 cells was found; during 10 days, infection with genotype 1, 2 and 6 recombinants did not induce intracellular lipid accumulation (FIG. 17), and no genotype specific differences in lipid content were found at peak infection (Table 10). A short-term infection in cell culture might not induce the changes in lipid metabolism leading to steatosis in chronically infected patients. Even though the inventors analyzed an average of 660 cells per culture for each time-point, it is evident that there was variation in the lipid content in infected as well as non-infected cells, which might mask possible subtle differences in lipid content induced by HCV. Furthermore, the inventors based their analysis on quantification of fluorescent intensity to quantify the total amount of lipids in the cell cytoplasm. Thus, morphological differences of lipid droplets between infected and non-infected cells were not analysed, which has been carried out in HCV infected cells by electron microscopy and in HCV Core expressing cells by confocal microscopy.

Figure 18:
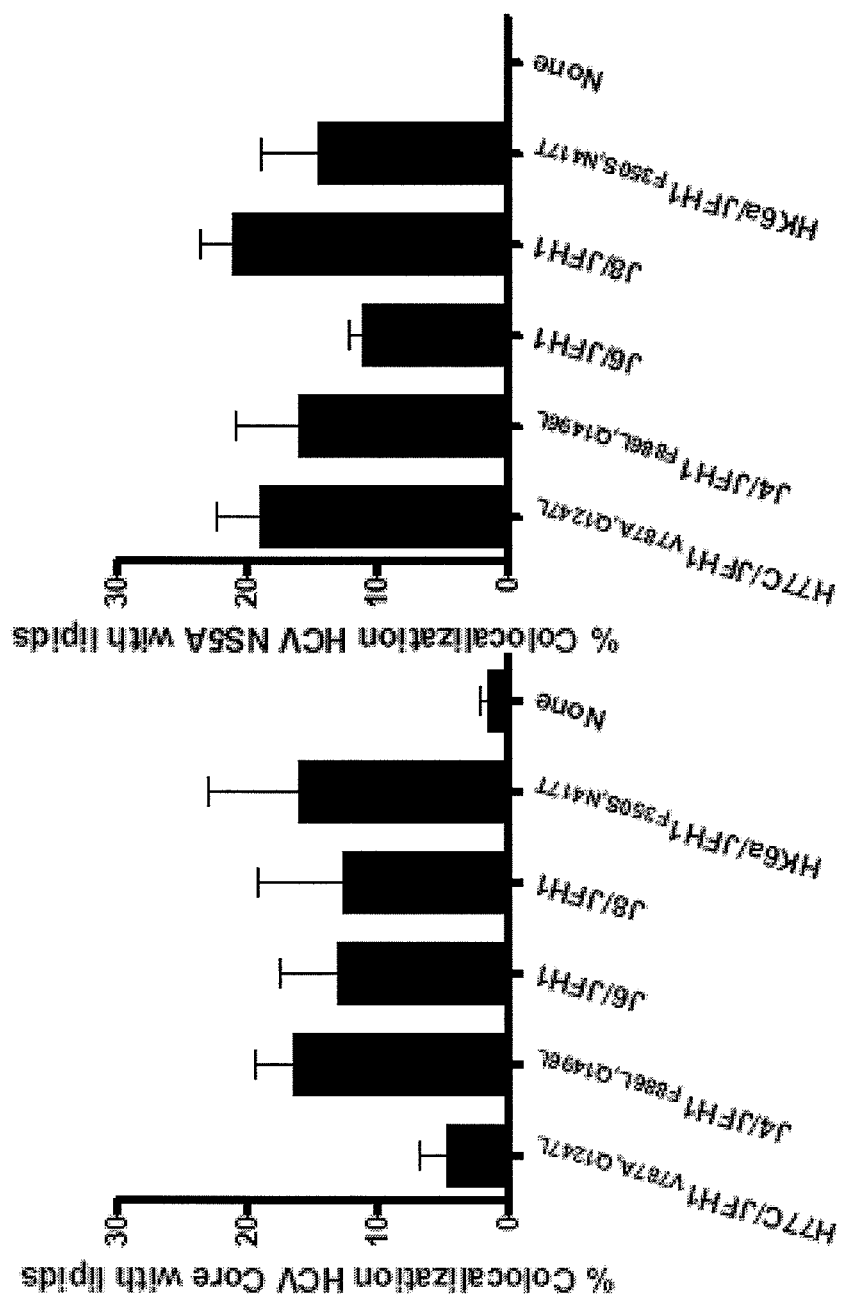

The present inventors found HCV Core to co-localize with lipid droplets for genotype 1, 2 and 6 recombinants (FIG. 18) as described by others for genotype 2a; further, co-localization of NS5A with lipid droplets was detected for genotype 1, 2 and 6 recombinants (FIG. 18), indicating either a direct or Core-mediated association. Interestingly, the interaction of NS5A with Core was found to play an important role in regulating the early phase of HCV particle formation.

Kits

In a related aspect, the invention also provides a test kit for HCV comprising HCV virus components, and a diagnostic test kit for HCV comprising components derived from an HCV virus as described herein.

Furthermore the invention also provide test kits, for screening for new HCV genotype 1a/1b, 2a, 3a, 4a, 5a and 6a inhibitors, neutralizing and cross neutralizing antibodies, comprising HCV virus components.

General

Reference to any prior art in this specification is not, and should not be taken as, an acknowledgment or any form of suggestion that this prior art forms part of the common general knowledge in any country.

All patent and non-patent references cited in the present application, are hereby incorporated by reference in their entirety.

As will be apparent, preferred features and characteristics of one aspect of the invention may be applicable to other aspects of the invention. The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

In addition, singular reference does not exclude a plurality. Thus, references to "a", "an", "first", "second" etc. do not preclude a plurality.

The invention may be embodied in other specific forms without departing from the spirit or essential characteristics thereof. The foregoing embodiments are therefore to be considered in all respects illustrative rather than limiting on the invention described herein. Scope of the invention is thus showed be the appended claims rather than by the foregoing description, and all changes that come within the meaning and range of equivalency of the claims are intended to be embraced by reference therein.

The invention will hereinafter be described by way of the following non-limiting Figures and Examples.

| Sequences | | |
|---|---|---|
| SEQ ID NO | DNA/AMINO ACID (AA) | NAME |
| SEQ ID NO: 1 | DNA | H77C/JFH1 |
| SEQ ID NO: 2 | AA | H77C/JFH1 |
| SEQ ID NO: 3 | DNA | J4/JFH1 |
| SEQ ID NO: 4 | AA | J4/JFH1 |
| SEQ ID NO: 5 | DNA | TN/JFH1 |

-continued

Sequences

| SEQ ID NO | DNA/AMINO ACID (AA) | NAME |
|---|---|---|
| SEQ ID NO: 6 | AA | TN/JFH1 |
| SEQ ID NO: 7 | DNA | H77C/JFH1$_{V787A}$ |
| SEQ ID NO: 8 | DNA | H77C/JFH1$_{V787A, Q1247L}$ |
| SEQ ID NO: 9 | DNA | H77C/JFH1$_{Q1247L}$ |
| SEQ ID NO: 10 | DNA | H77C/JFH1$_{R1408W}$ |
| SEQ ID NO: 11 | DNA | H77C/JFH1$_{I1312V}$ |
| SEQ ID NO: 12 | DNA | H77C/JFH1$_{K1398Q}$ |
| SEQ ID NO: 13 | DNA | J4/JFH1$_{F886L}$ |
| SEQ ID NO: 14 | DNA | J4/JFH1$_{Q1496L}$ |
| SEQ ID NO: 15 | DNA | J4/JFH1$_{S2484P}$ |
| SEQ ID NO: 16 | DNA | J4/JFH1$_{F886L, Q1496L}$ |
| SEQ ID NO: 17 | DNA | J4/JFH1$_{F886L, Q1496L, S2484P}$ |
| SEQ ID NO: 18 | DNA | J4/JFH1$_{Q1247L}$ |
| SEQ ID NO: 19 | DNA | J4/JFH1$_{I1312V}$ |
| SEQ ID NO: 20 | DNA | J4/JFH1$_{K1398Q}$ |
| SEQ ID NO: 21 | DNA | J4/JFH1$_{R1408W}$ |
| SEQ ID NO: 22 | DNA | TN/JFH1$_{Q1247L}$ |
| SEQ ID NO: 23 | DNA | TN/JFH1$_{R1408W}$ |
| SEQ ID NO: 24 | DNA | TN/JFH1$_{V787A, Q1247L}$ |
| SEQ ID NO: 25 | AA | H77C/JFH1$_{V787A}$ |
| SEQ ID NO: 26 | AA | H77C/JFH1$_{V787A, Q1247L}$ |
| SEQ ID NO: 27 | AA | H77C/JFH1$_{Q1247L}$ |
| SEQ ID NO: 28 | AA | H77C/JFH1$_{R1408W}$ |
| SEQ ID NO: 29 | AA | H77C/JFH1$_{I1312V}$ |
| SEQ ID NO: 30 | AA | H77C/JFH1$_{K1398Q}$ |
| SEQ ID NO: 31 | AA | J4/JFH1$_{F886L}$ |
| SEQ ID NO: 32 | AA | J4/JFH1$_{Q1496L}$ |
| SEQ ID NO: 33 | AA | J4/JFH1$_{S2484P}$ |
| SEQ ID NO: 34 | AA | J4/JFH1$_{F886L, Q1496L}$ |
| SEQ ID NO: 35 | AA | J4/JFH1$_{F886L, Q1496L, S2484P}$ |
| SEQ ID NO: 36 | AA | J4/JFH1$_{Q1247L}$ |
| SEQ ID NO: 37 | AA | J4/JFH1$_{I1312V}$ |
| SEQ ID NO: 38 | AA | J4/JFH1$_{K1398Q}$ |
| SEQ ID NO: 39 | AA | J4/JFH1$_{R1408W}$ |
| SEQ ID NO: 40 | AA | TN/JFH1$_{Q1247L}$ |
| SEQ ID NO: 41 | AA | TN/JFH1$_{R1408W}$ |
| SEQ ID NO: 42 | AA | TN/JFH1$_{V787A, Q1247L}$ |
| SEQ ID NO: 43 | DNA | -285s-HCV-MOD |
| SEQ ID NO: 44 | DNA | 9470R_JFH1 |
| SEQ ID NO: 45 | DNA | -84S_HCV-MOD |
| SEQ ID NO: 46 | DNA | 1aF965 |
| SEQ ID NO: 47 | DNA | 1aF1910 |
| SEQ ID NO: 48 | DNA | 1abF2729 |
| SEQ ID NO: 49 | DNA | 1abR1321 |
| SEQ ID NO: 50 | DNA | 1aR2038 |
| SEQ ID NO: 51 | DNA | 1aR2815 |
| SEQ ID NO: 52 | DNA | 3329R_JFH1-MOD |
| SEQ ID NO: 53 | DNA | 1bF965 |
| SEQ ID NO: 54 | DNA | 1bF1910 |
| SEQ ID NO: 55 | DNA | 1bR1995 |
| SEQ ID NO: 56 | DNA | 1bR2815 |
| SEQ ID NO: 57 | DNA | TNF965 |
| SEQ ID NO: 58 | DNA | TNF2729 |
| SEQ ID NO: 59 | DNA | 3081S_J6/JFH1 |
| SEQ ID NO: 60 | DNA | 3880S_J6 |
| SEQ ID NO: 61 | DNA | 4528S_J6 |
| SEQ ID NO: 62 | DNA | 5272S_JFH1 |
| SEQ ID NO: 63 | DNA | 6186S_JFH1 |
| SEQ ID NO: 64 | DNA | 6862S_JFH1 |
| SEQ ID NO: 65 | DNA | 7741S_J6 |
| SEQ ID NO: 66 | DNA | 8137S_JFH1 |
| SEQ ID NO: 67 | DNA | 4118R_JFH1 |
| SEQ ID NO: 68 | DNA | 4796R_JFH1 |
| SEQ ID NO: 69 | DNA | 5446R_JFH1 |
| SEQ ID NO: 70 | DNA | 6460R_J6 |
| SEQ ID NO: 71 | DNA | 7234R_JFH1 |
| SEQ ID NO: 72 | DNA | 7848R_JFH1 |
| SEQ ID NO: 73 | DNA | 8703R_JFH1 |
| SEQ ID NO: 74 | DNA | 9464R(24)_JFH1 |
| SEQ ID NO: 75 | DNA | DBN/JFH1 |
| SEQ ID NO: 76 | DNA | DBN/JFH1(K1405Q) |
| SEQ ID NO: 77 | DNA | DBN/JFH1(T794S, K1405Q) |
| SEQ ID NO: 78 | AA | DBN/JFH1 |
| SEQ ID NO: 79 | AA | DBN/JFH1(K1405Q) |
| SEQ ID NO: 80 | AA | DBN/JFH1(T794S, K1405Q) |

-continued

Sequences

| SEQ ID NO | DNA/AMINO ACID (AA) | NAME |
|---|---|---|
| SEQ ID NO: 81 | DNA | H77C/JFH1 (Q1496L) |
| SEQ ID NO: 82 | DNA | TN/JFH1 (D1431N) |
| SEQ ID NO: 83 | DNA | TN/JFH1 (E1699G) |
| SEQ ID NO: 84 | DNA | TN/JFH1 (D1431N, E1699G) |
| SEQ ID NO: 85 | DNA | DBN/JFH1 (T1096A) |
| SEQ ID NO: 86 | DNA | DBN/JFH1 (T2327A) |
| SEQ ID NO: 87 | DNA | DBN/JFH1 (T1096A, T2327A) |
| SEQ ID NO: 88 | DNA | DBN/JFH1 (W845R, K1405Q) |
| SEQ ID NO: 89 | AA | H77C/JFH1 (Q1496L) |
| SEQ ID NO: 90 | AA | TN/JFH1 (D1431N) |
| SEQ ID NO: 91 | AA | TN/JFH1 (E1699G) |
| SEQ ID NO: 92 | AA | TN/JFH1 (D1431N, E1699G) |
| SEQ ID NO: 93 | AA | DBN/JFH1 (T1096A) |
| SEQ ID NO: 94 | AA | DBN/JFH1 (T2327A) |
| SEQ ID NO: 95 | AA | DBN/JFH1 (T1096A, T2327A) |
| SEQ ID NO: 96 | AA | DBN/JFH1 (W845R, K1405Q) |

EXAMPLES

Materials and Methods

Construction of JFH1-Based Genotype Recombinants.

pH77C/JFH1 and pJ4/JFH1 were constructed from previously developed consensus clones pH77C and pJ4 respectively. We constructed pH77C/JFH1 and pJ4/JFH1 containing (i) the 5'UTR of the JFH1 isolate (nts 1-340); (ii) Core through NS2 of H77C or J4, respectively (nts 341-3418); and (iii) NS3 through 3'UTR of JFH1 (nts 3418-9666). A 3 piece fusion PCR containing the 5'UTR/Core and the NS2/NS3 junctions was inserted directly into pUC-JFH1. Cycle parameters for final fusion PCR were 45" at 95° C., 35 cycles of 45" at 95° C., 45" at 60° and 5' at 72°, followed by a final 10' at 72° C. For reverse genetic studies, mutations were introduced using mutated primers in fusion PCRs. All PCRs were done using Pfu polymerase (Stratagene). DNA stocks of final plasmids were prepared using QIAGEN EndoFree Plasmid Maxi Kit. The complete HCV sequence of final plasmid preparations was confirmed.

pTN/JFH1 was constructed by insertion of the AgeI-SpeI fragment of a fusion product containing JFH1 5'UTR, TN Core-NS2, and JFH1 NS3 into pJFH1. The JFH1 and TN fragments were amplified from pJFH1 and pHC-TN (GenBank accession number EF621489) respectively.

pDBN/JFH1 was constructed by first establishing the Core-NS2 consensus sequence of genotype 3a HCV present in serum of a German patient. By standard cloning and PCR techniques, the consensus sequence was constructed, and the Core-NS2 region was inserted by fusion PCR into pJ6/JFH, replacing the J6 Core-NS2.

Culturing, Transfection and Infection of Huh7.5 Cells.

Culturing of Huh7.5 cells was done as described by Gottwein et al. 2007. One day prior to transfection or infection, naïve Huh7.5 cells were plated at $3\times10^5$/well in 6-well plates. In vitro transcription was carried out for 2 hours with T7 RNA polymerase (Promega) on 5 µg plasmid linearized with XbaI and treated with Mung Bean Nuclease (New England Biolabs) to yield the exact HCV 3'end. For transfection, 2.5 µg of unpurified RNA transcripts were incubated with 5 µL Lipofectamine2000 (Invitrogen) in 500 µL Opti-MEM (Invitrogen) for 20 min at room temperature. RNA-Lipofectamine2000 transfection complexes were left on cells for 16-24 hours before washing. For infection, virus-containing supernatant was left on cells for 6-24 hours. Supernatants collected during experiments were sterile filtered and stored at −80° C.

Evaluation of Infected Cultures.

Anti-Core immunostaining was done with mouse anti-HCV Core protein monoclonal antibody (B2) (Anogen) as 1° antibody and Alexa Fluor 594 goat anti-mouse IgG (H+L) (Invitrogen) as 2° antibody. HCV RNA titers were determined by a TaqMan real-time PCR assay. Infectivity titers were determined using an earlier described protocol in Lindenbach et al. 2005. $6\times10^3$ naïve Huh7.5 cells were plated per well in a poly-D-lysine coated 96-well plate (Nunc) the day before inoculation with 10-fold dilutions of cell culture supernatants in replicates of 6 for 2-3 days. 1° Ab for development was anti-NS5A 9E10. 2° Ab was ECL anti-mouse IgG HRP-linked whole antibody (GE Healthcare Amersham). Staining was developed using DAB substrate kit (DAKO). Wells were scored positive if one or more cells were infected, and the $TCID_{50}$ value was calculated. Sequence analysis of recovered viruses was done as described in supporting information.

Neutralization of Virus by Patient Sera.

~100 $TCID_{50}$ virus were incubated for 1 hour at 37° C. with 2-fold dilutions of heat inactivated (56° C. for 30 min) patient sera or a mixture of sera from four healthy controls in final dilutions as indicated. The virus-serum mixture was incubated for 3 hours at 37° C. with $6\times10^3$ plated Huh7.5 cells in a poly-D-lysine coated 96-well plate. Cells were washed once, supplemented with fresh media and left for 2 days before staining as described for infectivity titration. FFUs were scored as above.

Direct sequencing of the complete ORF of recovered viruses. RT-PCR was done using SuperScriptIII (Invitrogen) and RT-primer 9470R_JFH1 (SEQ ID NO: 44). In 1$^{st}$ round PCR the Advantage 2 PCR Enzyme System and primers −285S_HCV-MOD (SEQ ID NO: 43) and 9470R_JFH1 were used. Cycle parameters were 35s at 99° C., 30s at 67° C. and 10 min (cycle 1-5), 11 min (cycle 6-15), 12 min (cycle 16-25) or 13 min (cycle 26-35) at 68° C. 12 ~1 kb products were synthesized in overlapping nested PCRs covering the entire ORF (nt 297-9427) using primer pairs 1-12 (Table 4). Cycle parameters were 35s at 99° C. followed by 35 cycles with 35s at 99° C., 30s at 67° C. and 6 min at 68° C. Sequencing, sequence analysis and databases. All sequence reactions were performed at Macrogen Inc., Seoul, South Korea. Sequence analysis was performed with Sequencher (Gene Codes Corporation) and BioEdit (Tom Hall, Ibis Therapeutics). HCV sequences were retrieved from the European HCV database (euHCVdb; http://euhcvdb.ibcp.fr/euHCVdb/) and the Los Alamos HCV sequence database (LANL; http://hcv.lanl.gov/content/hcv-db/index).

Example 1

Development of Viable H77C/JFH1 Recombinants and Homologous Neutralization with Chronic Phase Patient H Serum In order to study homologous neutralization with Patient H sera, the present inventors constructed pH77C/JFH1 with Core-NS2 from H77C. Following two independent transfections H77C/JFH1 spread to most cells after 41 or 19 days of culture, respectively (FIG. 1). Infectious virus could be passed to naïve cells yielding peak infectivity titers of ~10$^{3.5}$ TCID$_{50}$/mL and HCV RNA titers of ~10$^7$ IU/mL (FIGS. 2 and 3). Sequencing of the ORF of 1$^{st}$ passage virus from the two transfections identified dominant amino acid changes in p7 and NS3 (V787A and Q1247L) or in NS3 (R1408W), respectively (Table 1). Reverse genetic studies showed that introduction of either Q1247L or R1408W in NS3 allowed production of infectious viral particles with relatively high infectivity titers immediately after transfection (FIGS. 4 and 6). V787A alone did not confer viability (FIG. 6), but continuous propagation of H77C/JFH1$_{V787A}$ led to viral spread after acquisition of I1312V (NS3) and D2169A (NS5A). None of the three recombinants with mutations introduced in NS3 acquired additional changes after passage to naïve cells (Table 1).

Homologous neutralization of recombinant H77C/JFH1 virus was demonstrated with serum from Patient H, taken 29 years after acute infection (H06). Serial 2-fold dilutions of H06 serum were used to neutralize ~100 TCID$_{50}$ of H77C/JFH1, yielding a 50% neutralization titer of 1:1600 (FIG. 5, Table 3).

Example 2

Testing of Cross-Genotype Neutralization of Genotype 1-6 Recombinant Viruses with 1a and 4a Anti-Sera The H06 1a serum efficiently neutralized ED43/JFH1-y (4a/JFH1) with a 50% titer of 1:12800, while the AA 4a serum showed low-level neutralization of H77C/JFH1 with a 50% titer of 1:50 (Table 3). To further broaden the investigation of cross-genotype neutralization, serial 2-fold dilutions of 1a and 4a sera were tested against ~100 TCID$_{50}$ of JFH1-based recombinant viruses expressing the envelope proteins of genotype 2a, 3a, 5a, and 6a. Genotype 2a and 3a viruses could not be neutralized at a 1:50 dilution of either serum. However, genotype 5a and 6a viruses were efficiently neutralized by both sera with 50% neutralization titers of at least 1:3200 (Table 3).

Example 3

Development of Viable J4/JFH1 Recombinants

In order to be able to do HCV genotype 1b specific functional analyses and development of drug and vaccine candidates, the present inventors constructed pJ4/JFH1 with Core-NS2 from J4. Following transfection J4/JFH1 spread to most cells after 50 days of culture (FIG. 1). Infectious virus could be passed to naïve cells yielding peak infectivity titers of ~10$^4$ TCID$_{50}$/mL and HCV RNA titers of ~10$^7$ IU/mL (FIGS. 2 and 3). Sequencing of the ORF of 1$^{st}$ passage virus from the two transfections identified dominant amino acid changes in NS2, NS3 and NS5B (F886L, Q1496L and S2484P, Table 2). Additional mutations acquired after 2nd passage of virus to naïve cells are listed in Table 2. Reverse genetic studies showed that introduction of either F886L, Q1496L, F886L and Q1496L or F886L, Q1496L and S2484P in combination allowed production of infectious viral particles with relatively high infectivity titers immediately after transfection (FIGS. 7 and 8). S2484P alone did not confer viability (FIG. 7), but continuous propagation of J4/JFH1$_{S2484P}$ led to viral spread after 60 days of culture, indicating acquisition of adaptive mutations, as listed in Table 2. J4/JFH1$_{F886L}$, J4/JFH1$_{Q1496L}$, J4/JFH1$_{F886L,Q1496L}$ and J4/JFH1$_{F886L,Q1496L,S2484P}$ were passaged to naïve Huh7.5 cells, and we showed that these cells could immediately be infected, and infection spread to most cells in culture. Sequencing of viruses released to the supernatant in 1$^{st}$ passage showed that while J4/JFH1$_{F886L,Q1496L,S2484P}$ acquired no further mutations, J4/JFH1$_{F886L}$ had acquired G6148A (non coding) and a mixed mutation and original sequence at A4274G (coding for I1312V). Data accumulated from several transfection and passage experiments reveal that mutation of F886 to L, V, I or S in combination with an NS3 mutation (Q1496L as introduced in reverse genetic studies, or I1312V or R1408W) yield a stable efficient J4/JFH1 cell culture system (Table 2).

Example 4

Transfer of Mutations Across HCV Recombinants

Figure 9:
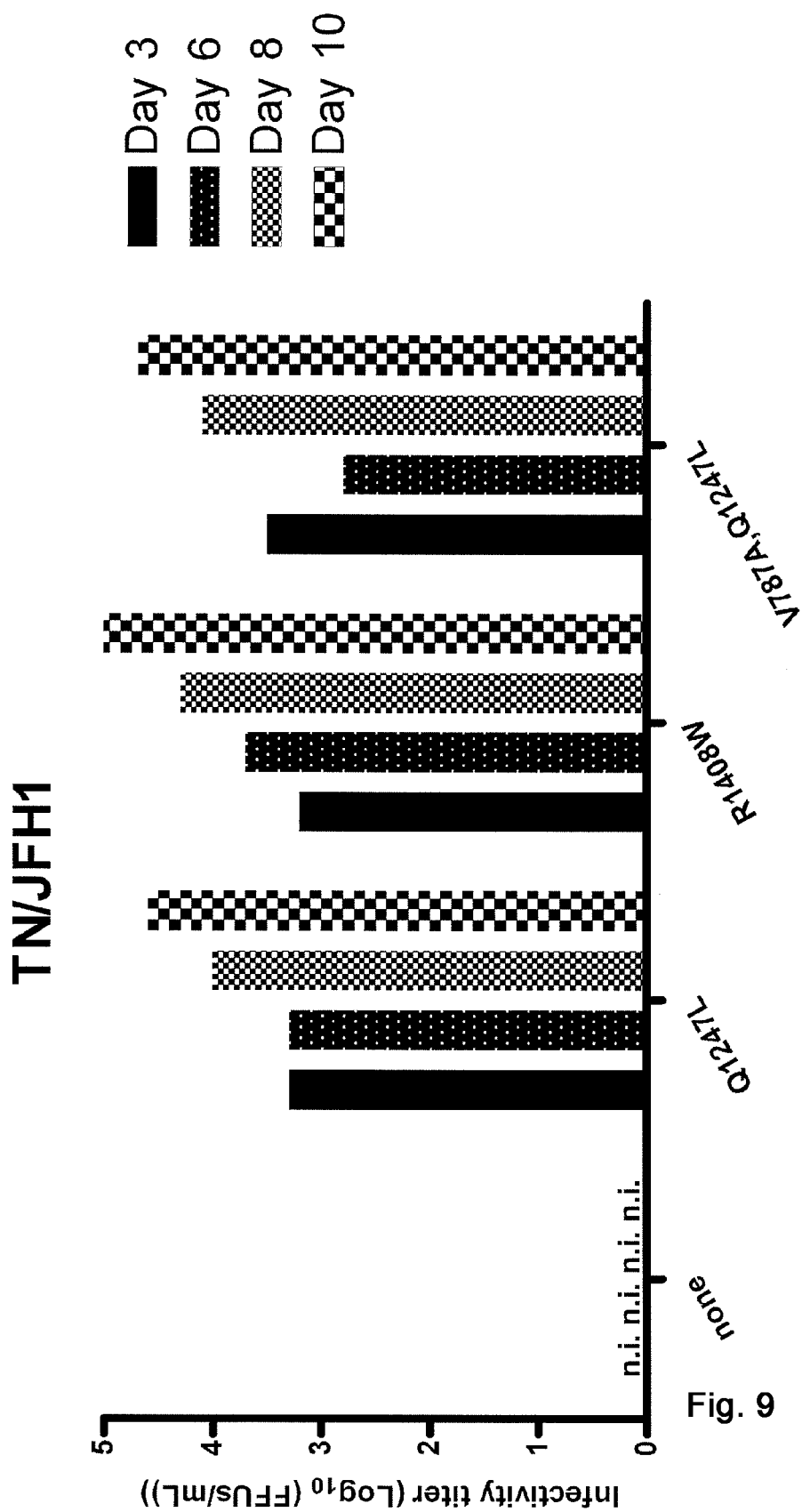
Figure 22A:
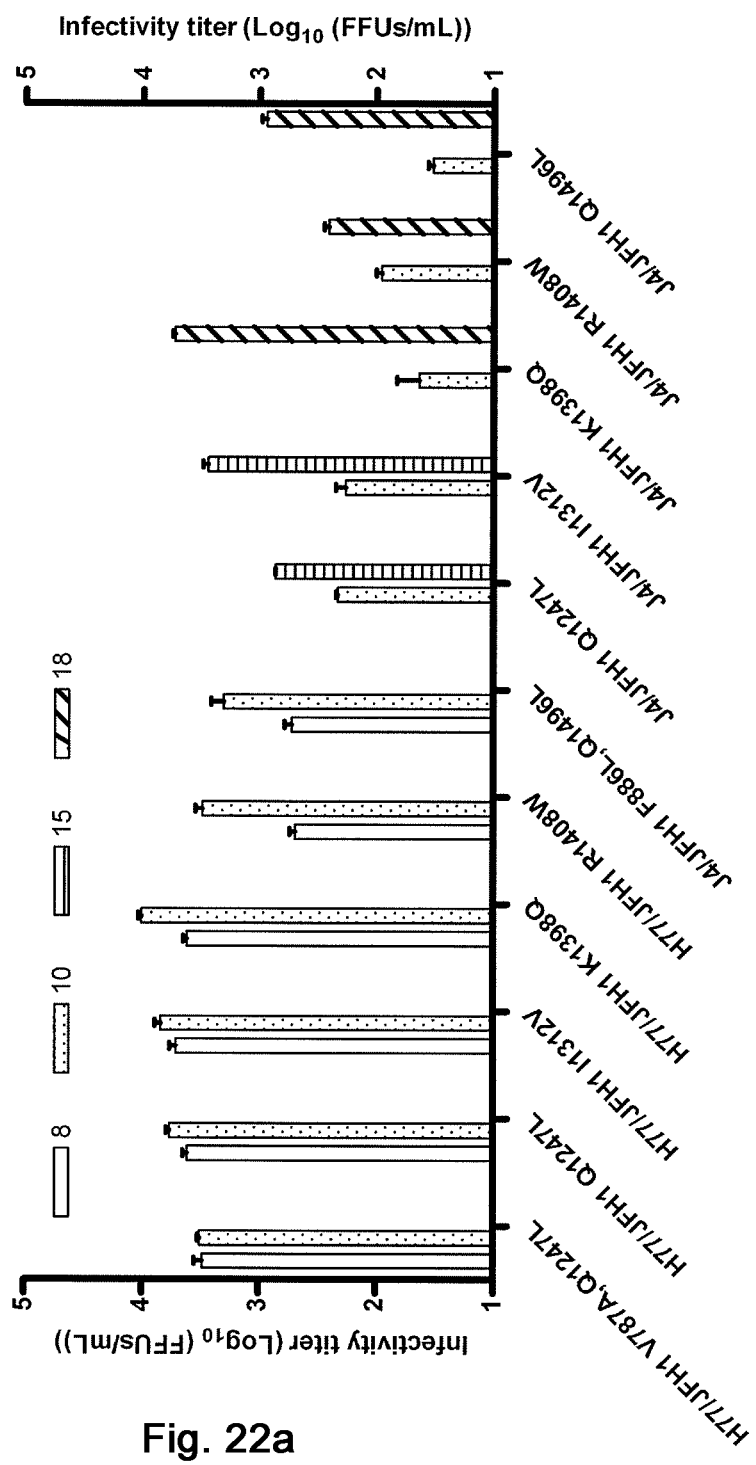
Figure 22B:
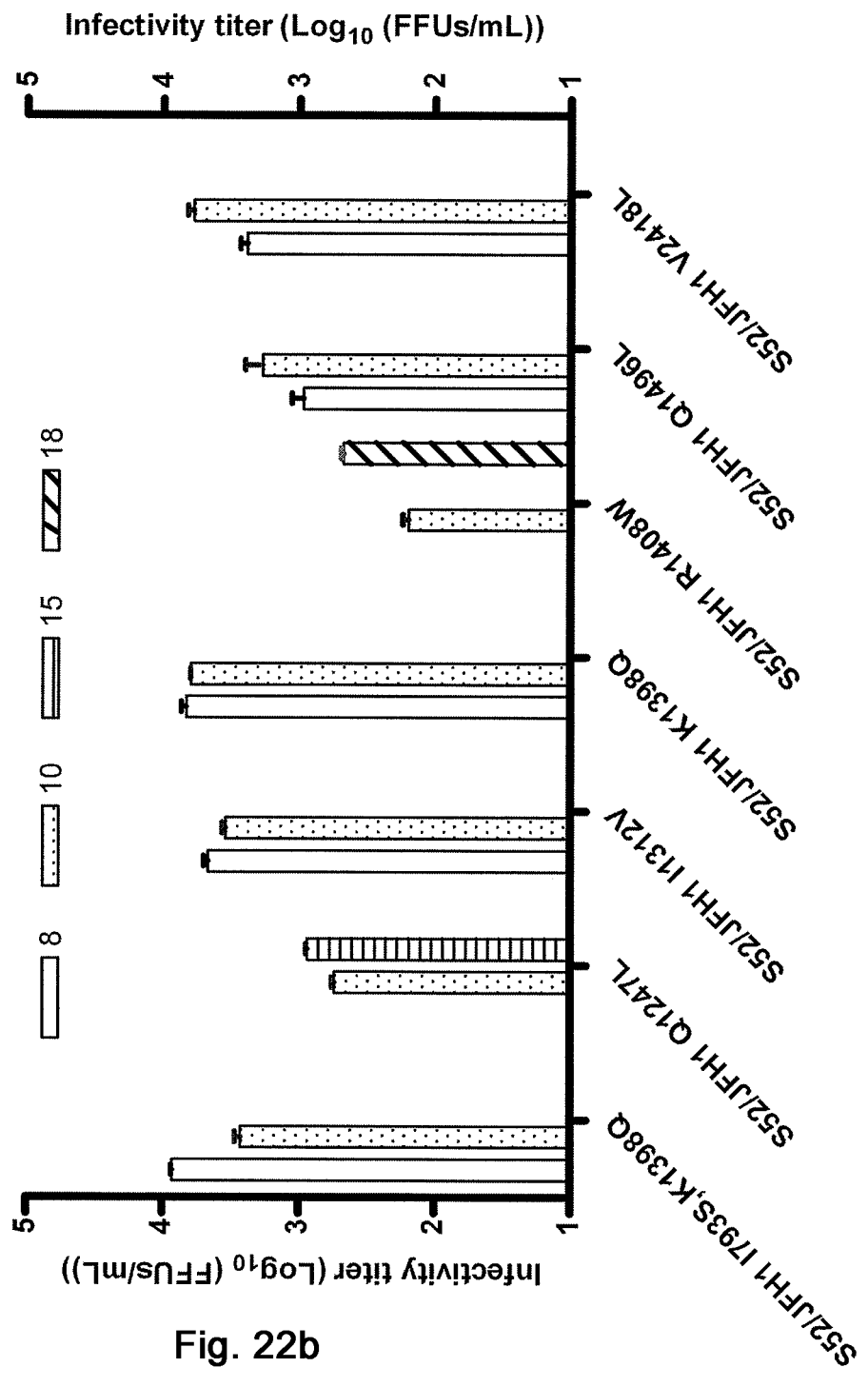
Figure 22C:
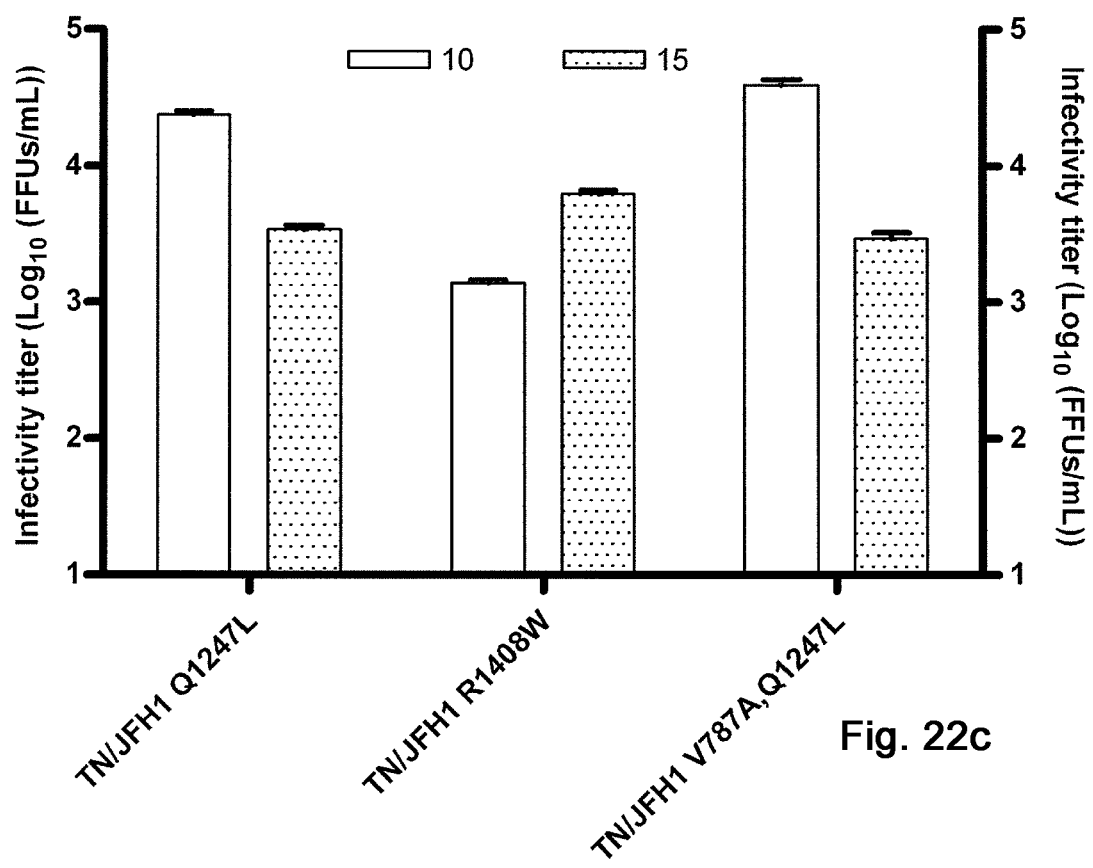

To be able to study the effect of cell culture adaptive mutations across isolates within the same subtype, the present inventors constructed TN/JFH1 (1a/2a) in analogy to H77/JFH1 (1a/2a). In a cross-isolate analysis, introduction of NS3 or p7/NS3 adaptive mutations observed for the H77/JFH1 virus, into the alternative 1a isolate (TN/JFH1) yielded relatively high infectivity titers, while no infectivity was recorded in the same time period for the TN/JFH1 without mutations (FIG. 9). Introduction of single NS3 mutations (Q1247L or R1408W) produced a genetically stable and efficient 1a recombinant, while introduction of V787A and Q1247L in combination resulted in further adaptation (FIG. 22B and Table 6).

Figure 10:
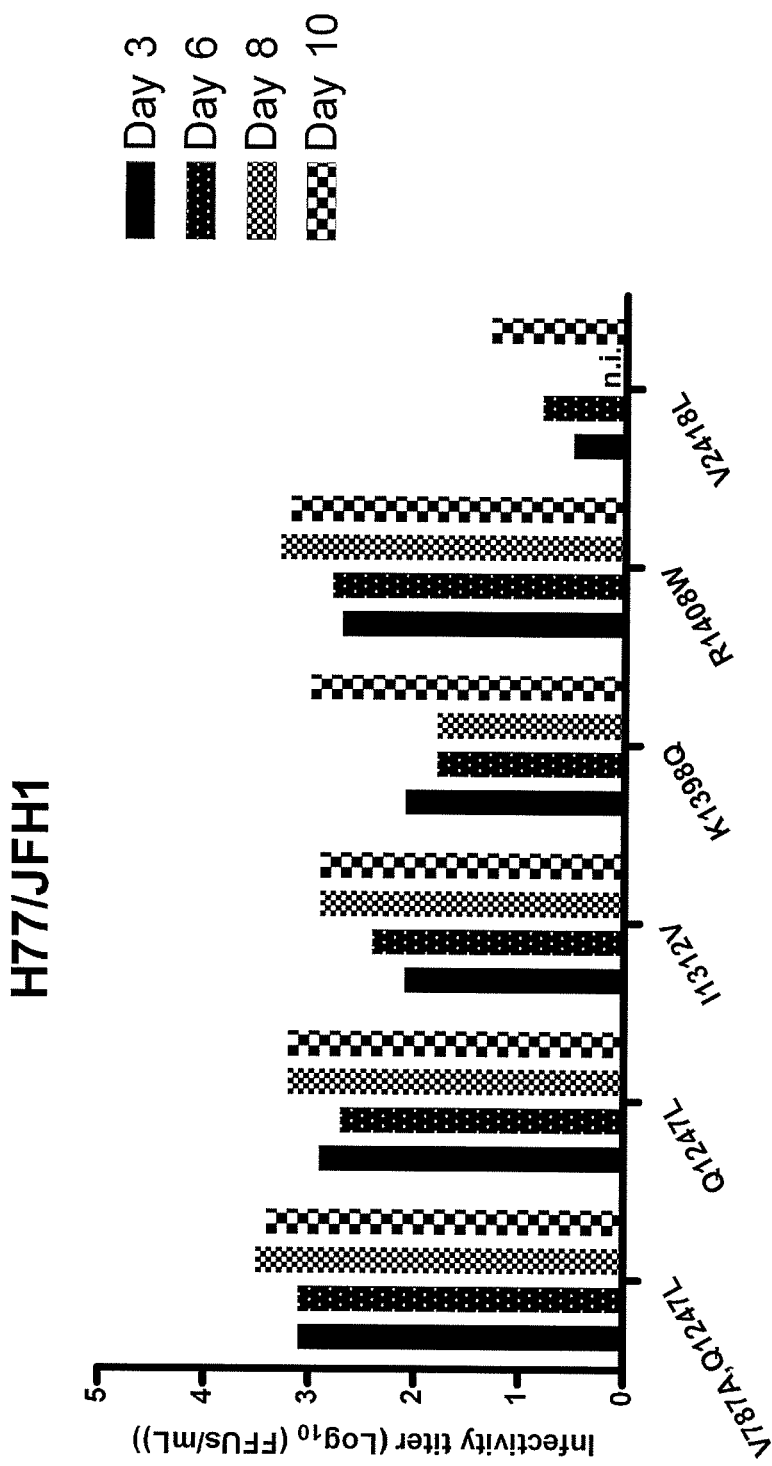
Figure 11:
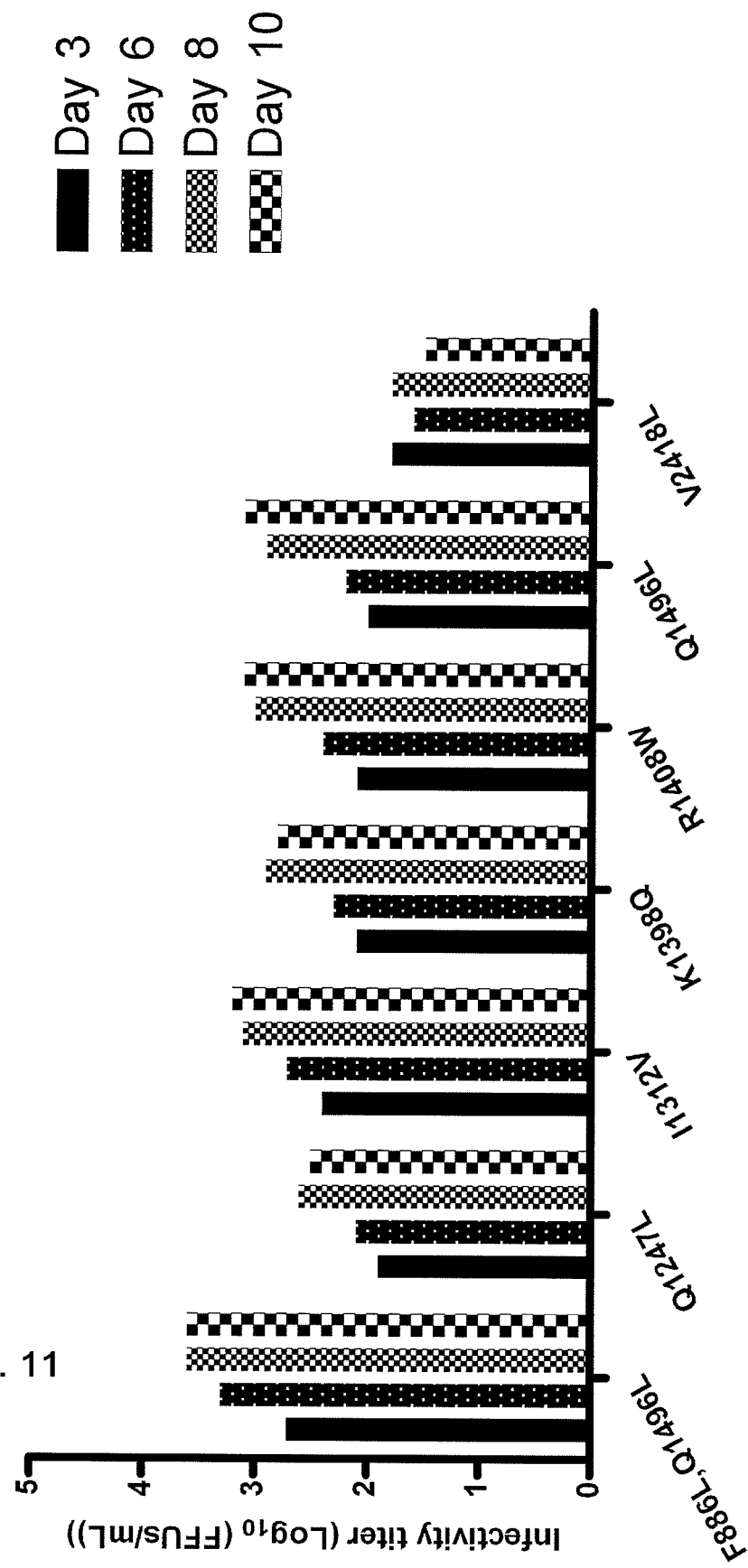
Figure 12:
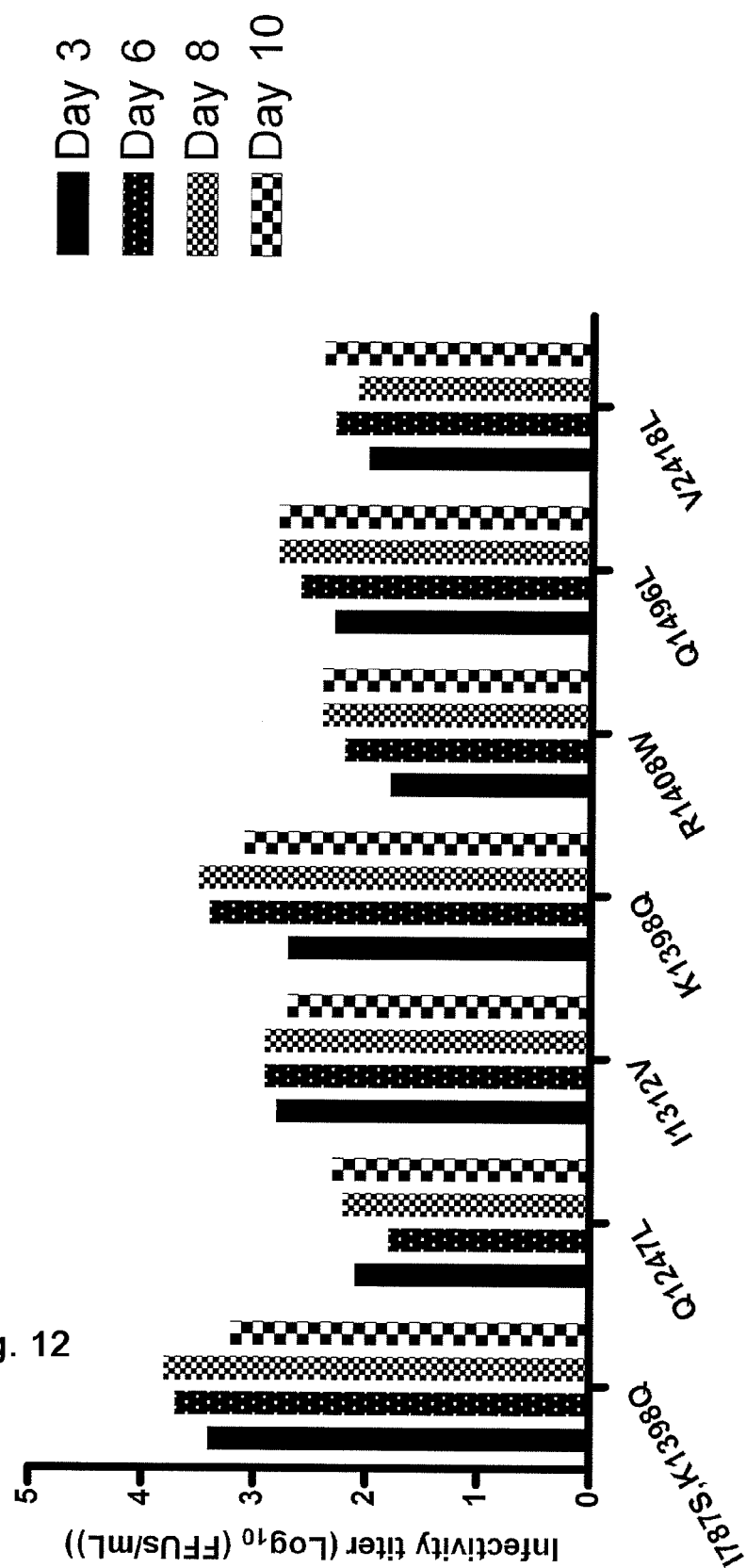
Figure 13:
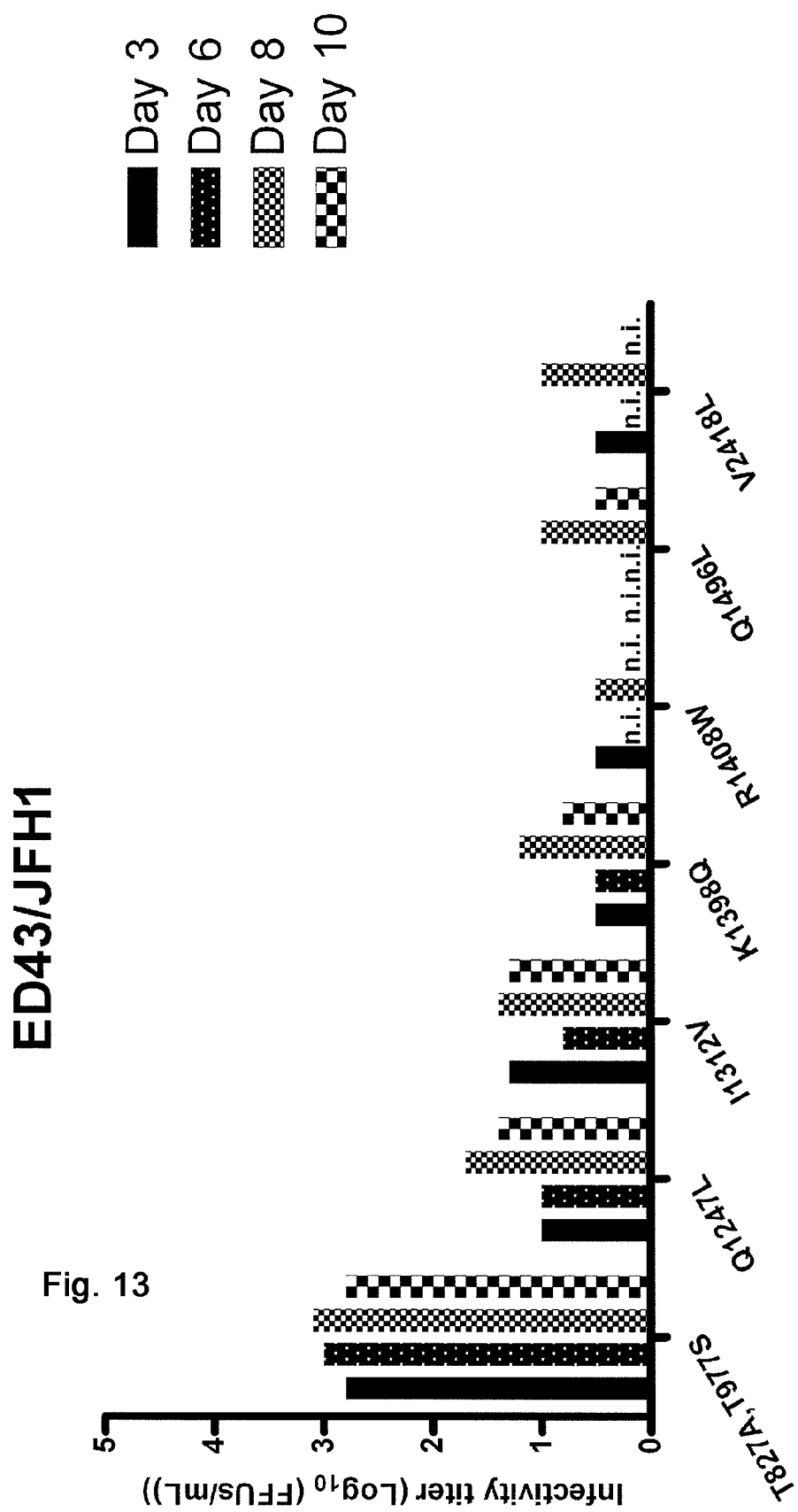

The inventors in addition transferred adaptive mutations across HCV subtypes and genotypes (Table 5). Replacement of previously found adaptive mutations by the NS3 mutations analysed in the cross-genotype and -subtype analysis resulted in kinetics comparably slower than for the optimally adapted recombinants for H77/JFH1 (1a/JFH1), J4/JFH1 (1b/JFH1) and S52/JFH1 (3a/JFH1), though still markedly better than for the un-adapted viruses (FIGS. 10, 11 and 12 showing infectivity titers of mutations analyzed in the cross-genotype experiment compared to FIGS. 1, 6 and 7 and (Gottwein et al. 2007) showing data for the original un-adapted recombinants). Compared to the tested NS3 mutations, the NS5A mutation yielded similar kinetics for 3a/JFH1 but slower kinetics for other genotypes (FIGS. 10, 11 and 12 showing infectivity titers of mutations analyzed in the cross-genotype experiment compared to FIGS. 1, 6 and 7 and (Gottwein et al. 2007) showing data for the original un-adapted recombinants). ED43/JFH1 (4a/JFH1) was not adapted by any of the tested mutations (FIG. 13, Table 9). H77/JFH1 (1a/JFH1), J4/JFH1 (1b/JFH1) and S52/JFH1 (3a/JFH1) virus producing infectivity titers above 100 FFUs/mL in transfection (FIGS. 10, 11 and 12) were passaged to naïve Huh7.5 cells. While some genotype 1 recombinants were genetically stable and efficient only after acquisition of certain mutations (FIGS. 22A and B and Table 7, 8 and 9), no additional mutations were observed for any tested 3a/JFH1 recombinants (Table 9).

Example 5

Development of Viable TN/JFH1 Recombinants

Figure 23A:
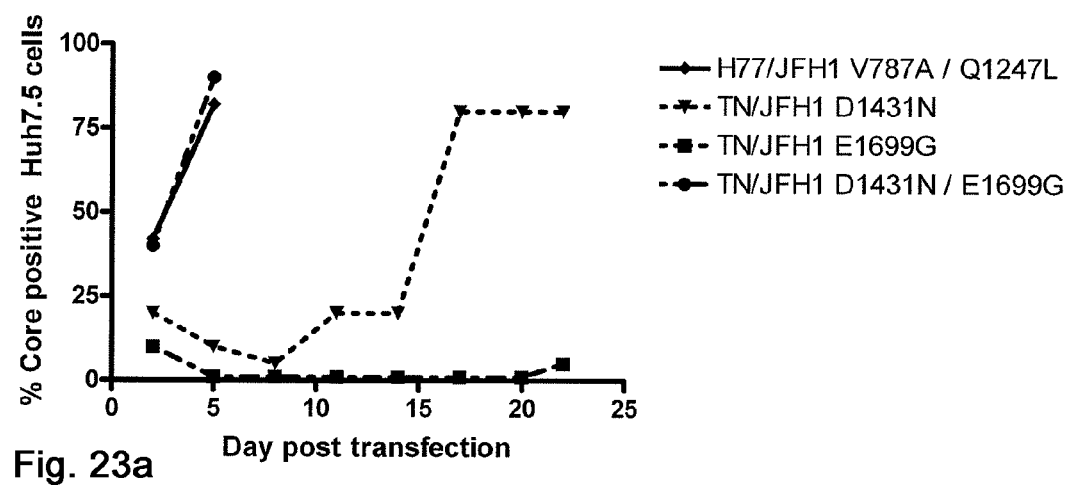
Figure 24A:
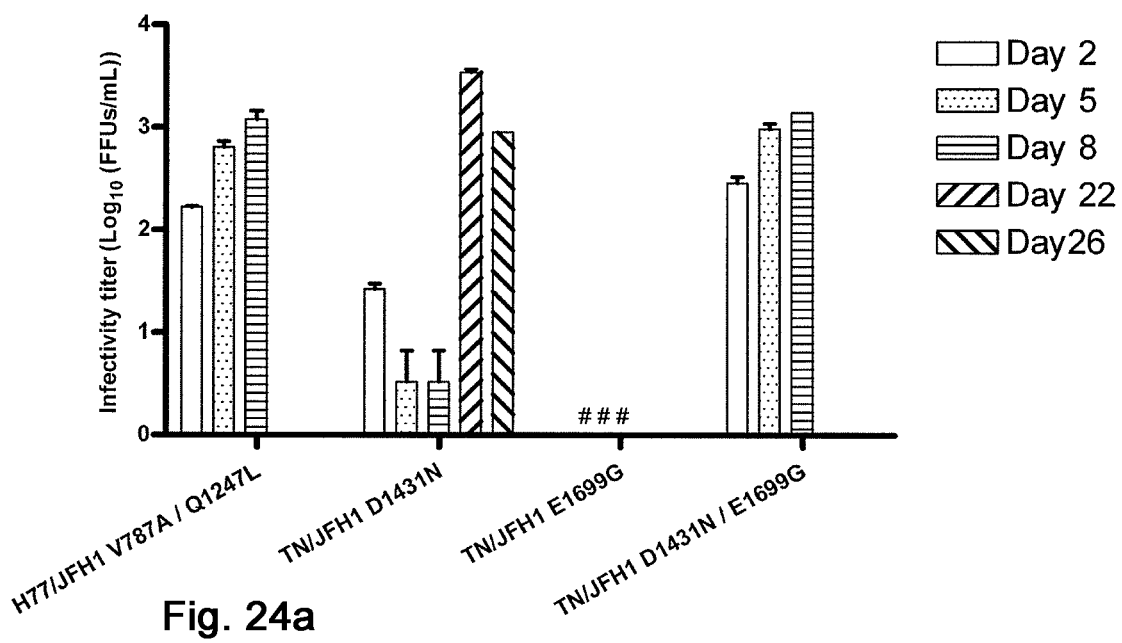
Figure 25A:
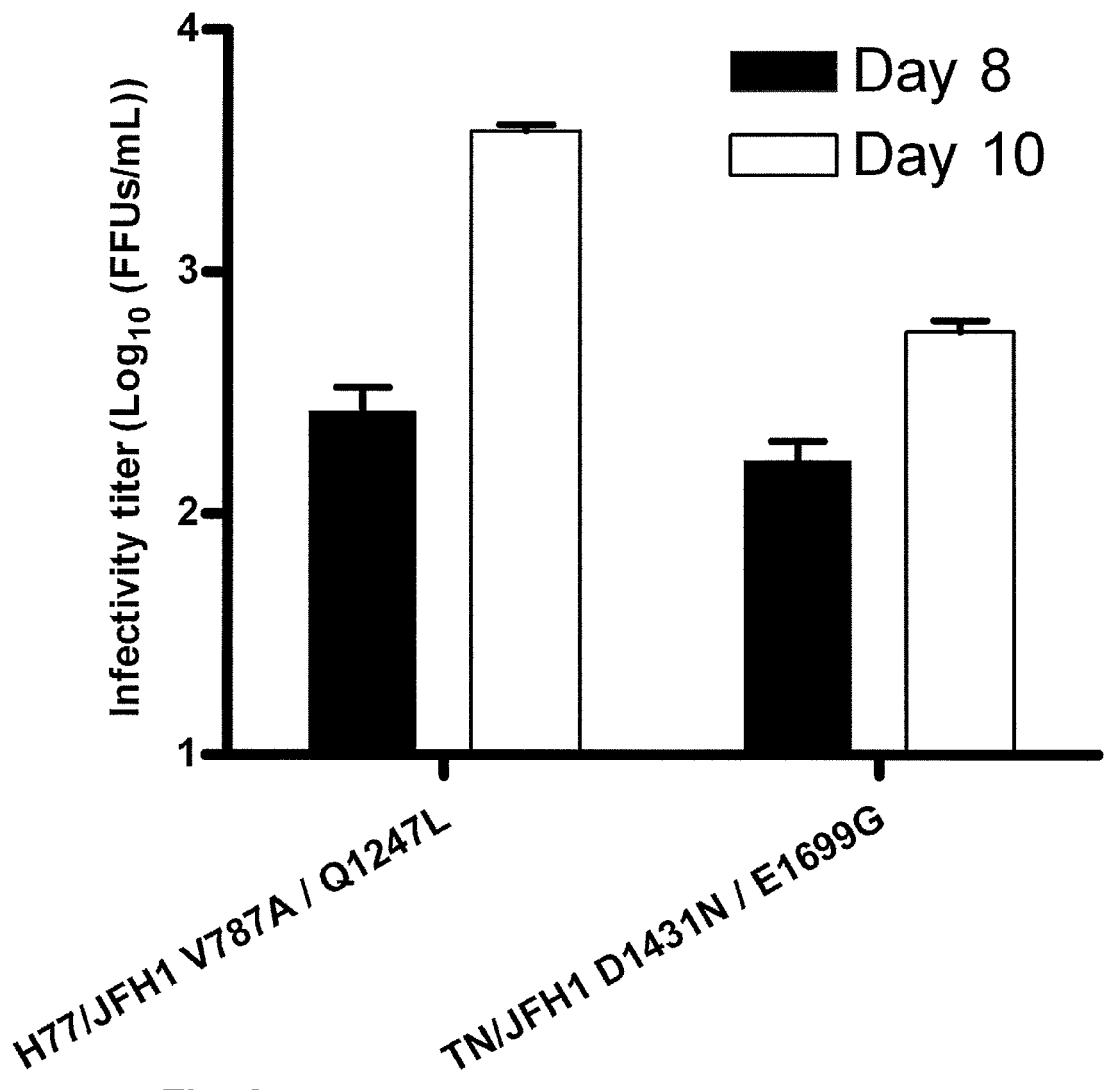

Development of viable TN/JFH1 recombinants adapted by mutations originally found for H77/JFH1 was described in Example 4. When transfecting the original TN/JFH1 without mutations, at first no infectivity was observed (FIG. 9). However when propagating it further, at day 46 it had spread to most cells in culture and acquired the amino acid adaptive mutations D1431N and E1699G in NS3 and NS4A, respectively (Table 6). These mutations were tested singly and in combination in a reverse genetic transfection experiment (FIGS. 23A and 24A, SEQ ID NOs: 82, 83 and 84 and deduced amino acid sequences SEQ ID NOs: 90, 91 and 92). Only the genome with the combination of mutations immediately produced high infectivity titers, could be passed to naïve cells and accumulated no further mutations (FIG. 25A, Table 6). Interestingly, when D1431N was introduced singly, the virus spread to the majority of the transfection culture after days. When the virus was sequenced after 22 days of culture, TN/JFH1$_{D1431N}$ had acquired A4532C (amino acid change K1398Q), a mutation that was shown to confer efficient growth also of J4/JFH1 (1b/JFH1) and S52/JFH1 (3a/JFH1) (see above). This points to an important function of this mutation in adaptation across genotypes, and that the combination of A4532C and D1431N yields and efficient TN/JFH1 recombinant.

Example 6

Transfer of Mutations Across HCV Genotype 3a Subtypes

To be able to study the effect of cell culture adaptive mutations across isolates within the same subtype the present inventors investigated whether adaptive mutations identified in the S52/JFH1 system (Gottwein et al. 2007) could facilitate cell culture adaptation of other genotype 3a JFH1-based recombinants.

Thus, the present inventors constructed DBN/JFH1, containing the consensus sequences of Core through NS2 of the genotype 3a isolate DBN, derived from a German patient, in the JFH1 backbone. T2718G in p7 and A4550C in NS3 (S52/JFH1 nucleotide positions, Table 11) were selected for the study since these adaptive mutations were able to individually confer cell culture adaptation of S52/JFH1 (nucleotide positions refer to S52/JFH1 sequence).

The present inventors engineered DBN/JFH1(A4553C) and DBN/JFH1(C2721G; A4553C) (nucleotide positions refer to DBN/JFH1 sequence). DBN/JFH1, DBN/JFH1 (A4553C) and DBN/JFH1(C2721G; A4553C) were transfected in parallel to the negative control S52/JFH1(GND) and the positive controls S52/JFH1(A4550C) and S52/JFH1 (T2718G; A4550C), which was constructed in order to test if combination of T2718G and A4550C on one S52/JFH1 genome produced an efficient cell culture system.

Figure 19:
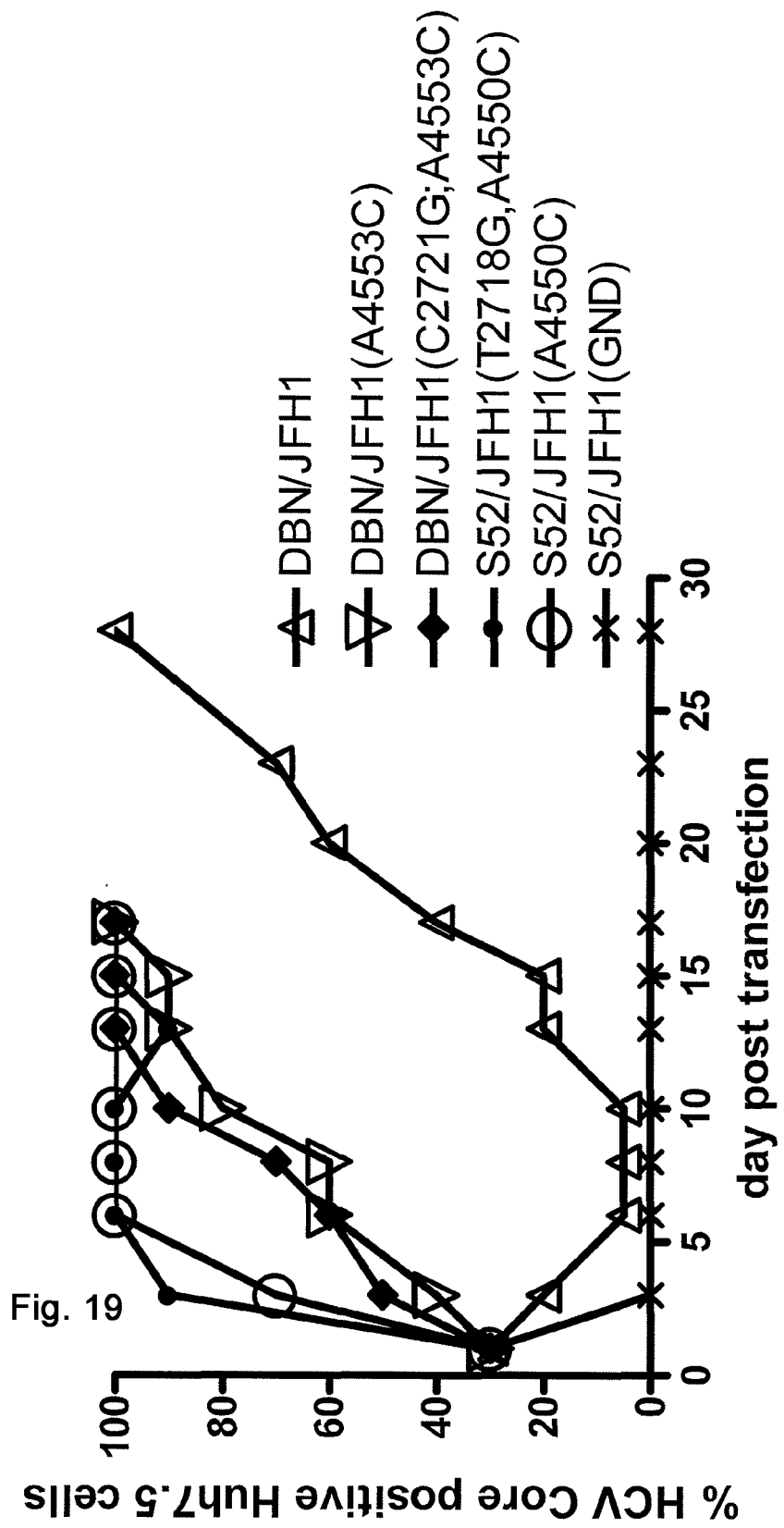

Whereas most cells in both positive control cultures were HCV antigen positive on day 6, DBN/JFH1(A4553C) and DBN/JFH1(C2721G; A4553C) spread to almost the entire culture on day 13 and DBN/JFH1 spread to almost the entire culture on day 28 (FIG. 19).

Figure 20:
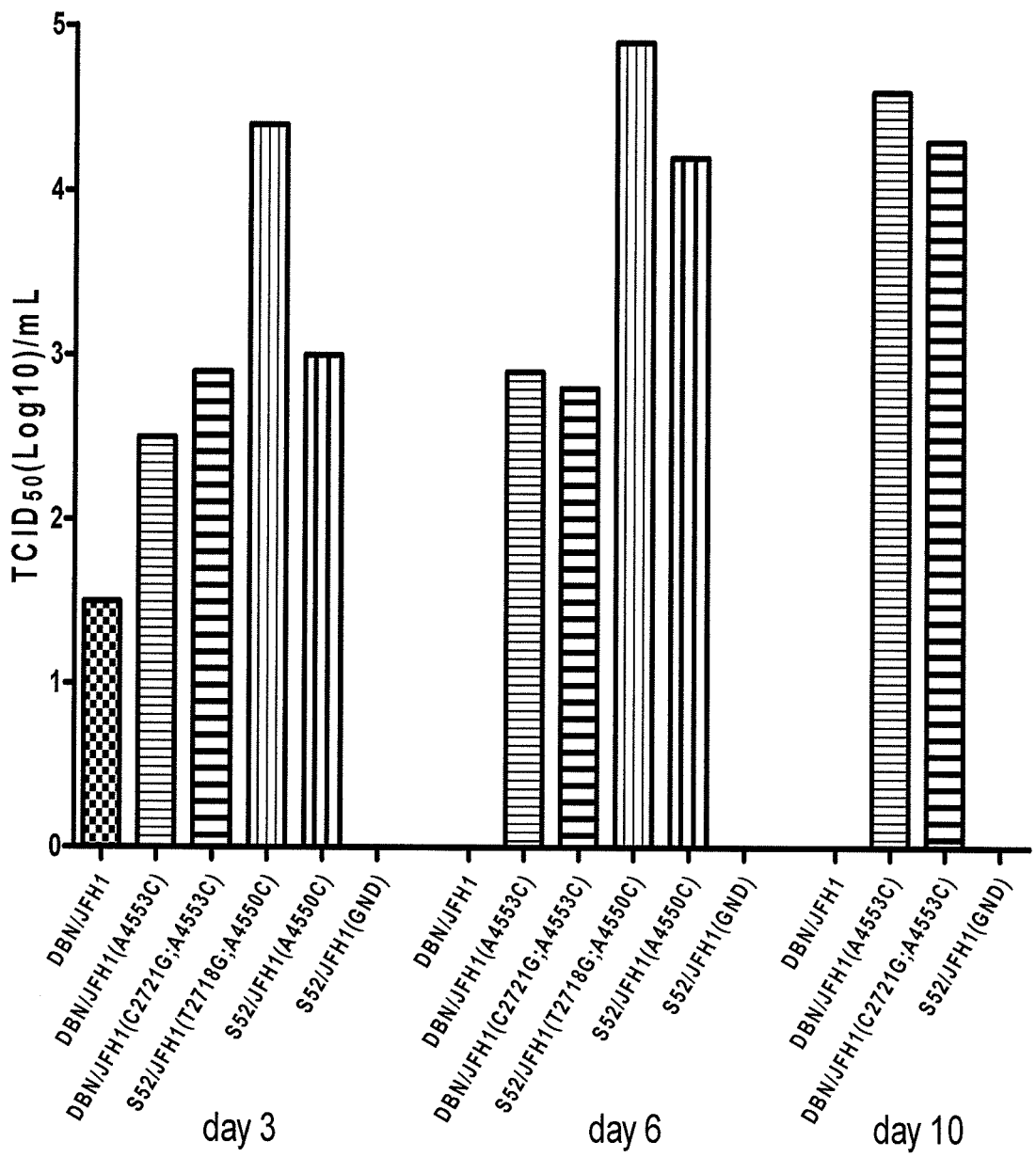

Determination of infectivity titers on day 3, 6, and 10 post transfection reflected the delayed spread of DBN/JFH1 (A4553C) and DBN/JFH1(C2721G; A4553C) compared to the adapted S52/JFH1 positive control genomes (FIG. 20). Whereas the latter yielded infectivity titers between $10^4$ and $10^5$ TCID$_{50}$/mL on day 6, such titers were first achieved on day 10 by DBN/JFH1(A4553C) and DBN/JFH1 (C2721G; A4553C) (FIG. 20). DBN/JFH1 without adaptive mutations was apparently not viable on day 6 and 10, leading to non-determinable infectivity titers. Thus, even though transfer of adaptive mutations across isolates within genotype 3a did not fully adapt the DBN/JFH1, some adaptation was clearly obtained, comparing DBN/JFH1(A4553C) and DBN/JFH1 (C2721G; A4553C) with DBN/JFH1.

Figure 21:
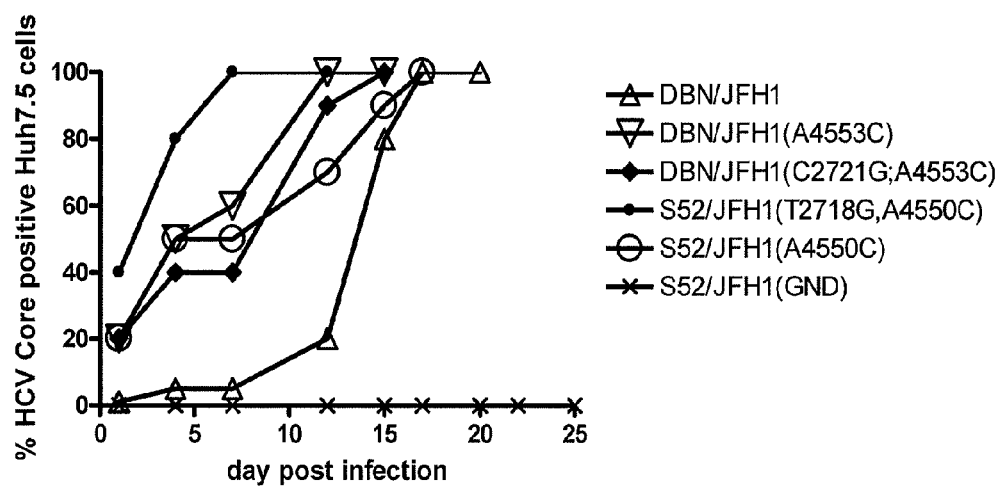

Subsequently, these viruses were passaged once by transfer of 1 mL supernatant derived from transfection cultures to naïve Huh7.5 cells (FIG. 21). Direct sequencing of the complete open reading frame of viral genomes was done on transfection (DBN/JFH1) and 1$^{st}$ passage (DBN/JFH1(A4553C) and DBN/JFH1 (C2721G; A4553C)) cell culture supernatants (Table 11). DBN/JFH1 had acquired one complete nucleotide/amino acid change (A3626G/T1096A) in NS3 on day 28 post transfection. DBN/JFH1(A4553C) and DBN/JFH1(C2721G; A4553C) both had acquired the complete amino acid change W845R in NS2 (which was coded by a different nucleotide change) (Table 11). 1$^{st}$ passage viral genomes of S52/JFH1(A4550C) (day 12) and S52/JFH1 (T2718G; A4550C) (day 7) were also sequenced; both were genetically stable.

Thus, it is shown that cell culture adaptation of a JFH1-based recombinant of another genotype 3a isolate (DBN) could be accelerated by introduction of adaptive mutations identified in the S52/JFH1 system. However, DBN/JFH1 genomes with one adaptive mutation in NS3 (K1405Q, referring to BDN/JFH1 sequence) apparently required a secondary mutation in NS2 (W845R).

Furthermore it is shown that the S52/JFH1(T2718G; A4550C) genome, combining the two adaptive mutations, which were able to individually provide adaptation of the S52/JFH1 genome, is viable and efficient in Huh7.5 cell culture.

Figure 23B:
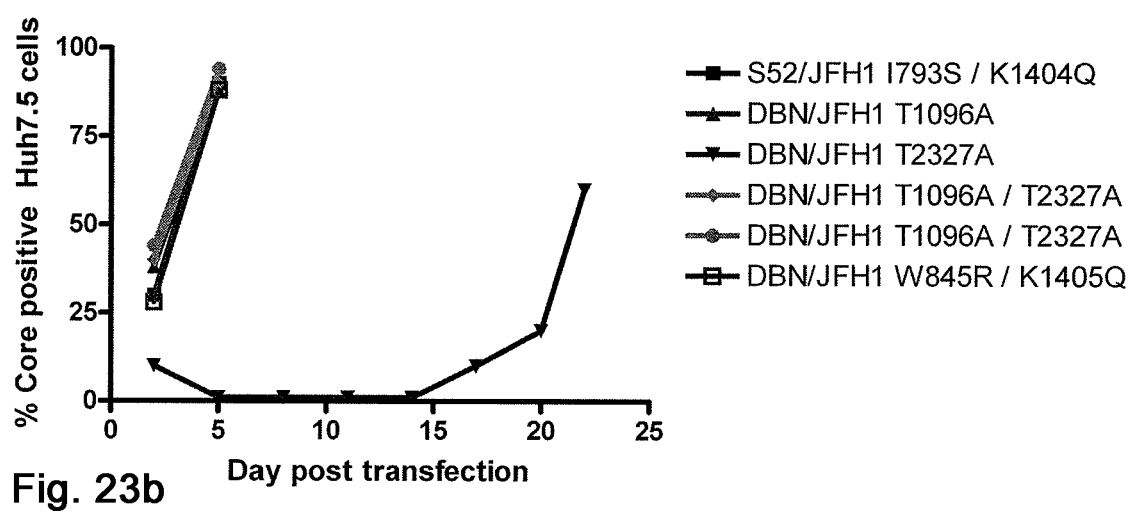
Figure 24B:
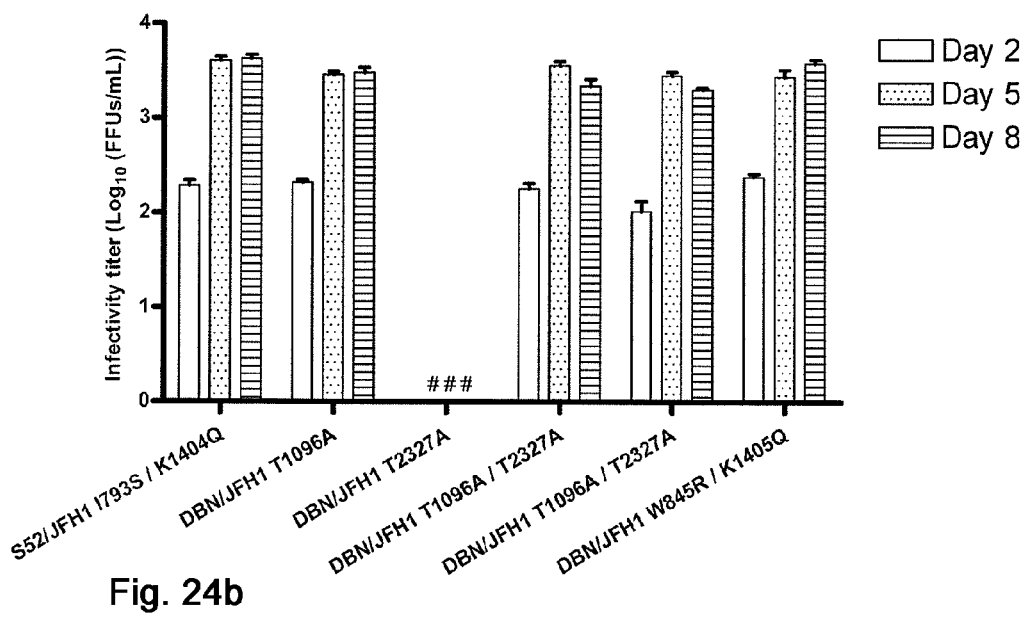
Figure 25B:
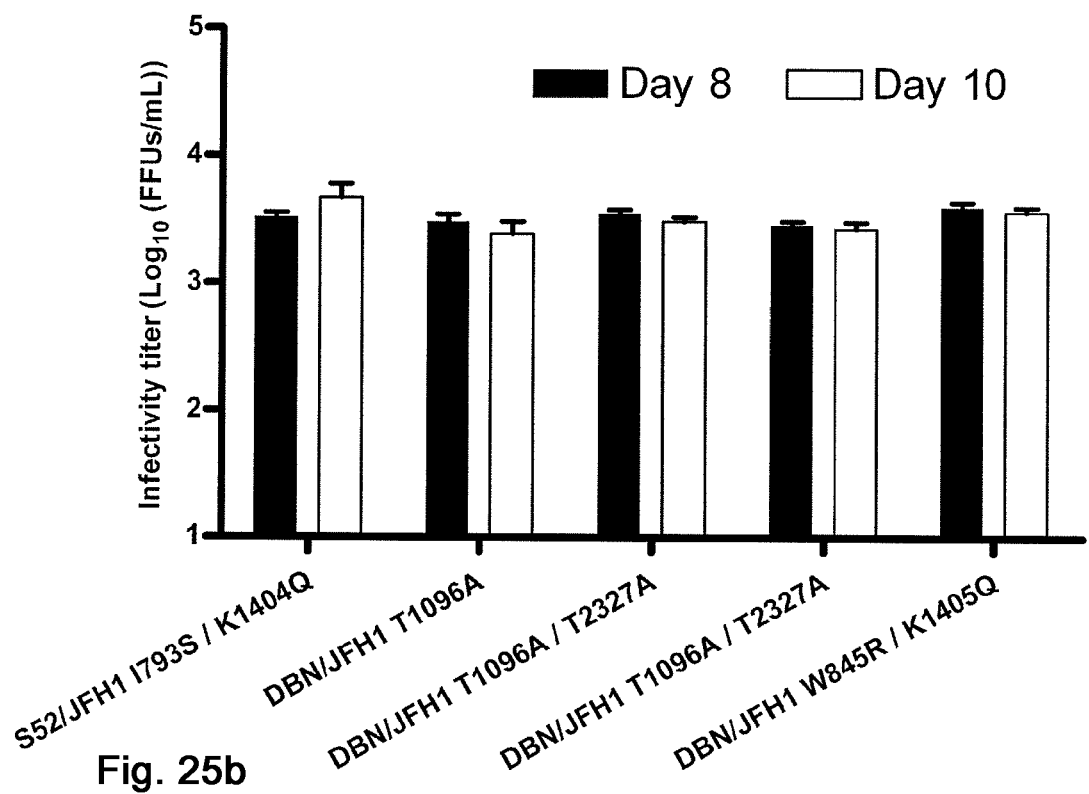

To further characterize the adaptive mutations found for the DBN/JFH1 virus, the present inventors constructed and tested, by transfection into cell culture pDBN/JFH1 T1096A, pDBN/JFH1 T2327A, pDBN/JFH1 T1096A/T2327A, and pDBN/JFH1 W845R/K1405Q (FIGS. 23B and 24B, SEQ ID NOs: 85, 86, 87 and 88 and deduced amino acid sequences SEQ ID NOs: 93, 94, 95 and 96). Genomes with the NS3 mutation T1096A present or the combination of W845R and K1405Q immediately spread in culture. These were passaged to naïve huh7.5 cells and efficiently produced infectious virus (FIG. 25B). Interestingly, when sequenced after 10 days of 1$^{st}$ passage culture, neither DBN/JFH1 T1096A, DBN/JFH1 T1096A, T2327A nor DBN/JFH1 W845R/K1405Q accumulated any additional mutations. On the contrary, DBN/JFH1 T2327A did not spread to the majority of transfection culture until day 22 post transfection. When sequenced after 26 days of culture, DBN/JFH1 T2327A in addition acquired T1096A. This shows that T1096A is an important adaptive mutation for DBN/JFH1.

Figure Legends

FIG. 1

H77C/JFH1 and J4/JFH1 recombinants and their viability in Huh7.5 cells.

Huh7.5 cells were transfected in parallel with RNA transcripts from pJ6/JFH, pH77C/JFH1, pJ4/JFH1 and pED43/JFH1-GND (replication negative control). After immunostaining, the percentage of HCV Core positive cells was scored using confocal fluorescence microscopy.

FIG. 2

Passage of J6/JFH, H77C/JFH1, J4/JFH1 and ED43/JFH1-GND from transfection culture (FIG. 1) to naïve Huh7.5 cells.

After immunostaining, the percentage of HCV Core positive cells was scored using confocal fluorescence microscopy. HCV RNA titers in culture supernatants monitored by HCV TaqMan. Supernatant infectivity titers were determined by $TCID_{50}$ assay.

FIG. 3

Passage of J6/JFH, H77C/JFH1, J4/JFH1 and ED43/JFH1-GND from $1^{st}$ passage culture (FIG. 2) to naïve Huh7.5 cells.

After immunostaining, the percentage of HCV Core positive cells was scored using confocal fluorescence microscopy. HCV RNA titers in culture supernatants monitored by HCV TaqMan. Supernatant infectivity titers were determined by $TCID_{50}$ assay.

FIG. 4

Infectivity titers after transfection of Huh7.5 cells with H77C/JFH1 recombinants with putative adaptive mutations.

RNA transcripts from $pH77C/JFH1_{Q1247L}$, $pH77C/JFH1_{V787A,Q1247L}$ and $pH77C/JFH1_{R1408W}$ were transfected into Huh7.5 cells. $TCID_{50}$ determinations on transfection supernatants are shown.

FIG. 5

Neutralization of H77C/JFH1 virus.

~100 $TCID_{50}$ of H77C/JFH1 $2^{nd}$ passage virus were incubated with serial 2-fold dilutions of genotype 4a (AA) or genotype 1a (H) chronic phase patient samples or a mixture of sera from four HCV negative controls in final dilutions as indicated, prior to incubation with Huh7.5 cells. 1:50 and 1:100 dilutions were tested in a separate experiment (not shown). The count of FFUs per well after an incubation period of 2 days is indicated. Each data point represents triplicate experiments. Error bars indicate standard errors of the mean.

FIG. 6

Infectivity titers after transfection of Huh7.5 cells with H77C/JFH1 recombinants with putative adaptive mutations.

RNA transcripts from pJ6/JFH and pJ6/JFH-GND, as well as pH77C/JFH1 constructs with or without V787A and Q1247L were transfected into Huh7.5 cells. $TCID_{50}$ determinations on transfection supernatants are shown. #, none ($TCID_{50}$=0) of 6 replicates infected by undiluted supernatant. J6/JFH-GND was confirmed negative.

FIG. 7

Infectivity titers after transfection of Huh7.5 cells with J4/JFH1 recombinants with putative adaptive mutations.

RNA transcripts from pJ6/JFH, pJ4/JFH1, $pJ4/JFH1_{F886L}$, $pJ4/JFH1_{Q1496L}$, $pJ4/JFH1_{S2484P}$ and $pJ4/JFH1_{F886L,Q1496L,S2484P}$ were transfected into Huh7.5 cells. $TCID_{50}$ determinations on transfection supernatants are shown. #, none ($TCID_{50}$=0) or *, 1-2 ($TCID_{50}$ undeterminable) of 6 replicates infected by undiluted supernatant. J6/JFH-GND was confirmed negative.

FIG. 8

Transfection of Huh7.5 cells with J4/JFH1 recombinants with putative adaptive mutations.

RNA transcripts from pJ6/JFH, $pJ4/JFH1_{F886L}$, $pJ4/JFH1_{Q1496L}$, and $pJ4/JFH1_{F886L,Q1496L}$ were transfected into Huh7.5 cells. After immunostaining, the percentage of HCV Core positive cells was scored using confocal fluorescence microscopy.

FIG. 9

Cross-isolate analysis of 1a adaptive mutations.

Efficient 1a JFH1-based systems (H77/JFH1) was created by introduction of the mutations V787A/Q1247L, Q1247L or R1408W. To test whether adaptation could be transferred to other isolates of the same subtype, another 1a strain was mutated (1a TN/JFH1) to express the same amino acid residues. Infectivity titers (focus forming units (FFUs)/mL) at the indicated days after transfection of the TN (1a) JFH1-based recombinant into Huh7.5 hepatoma cells are shown. n.i.: not infectious, n.d.: not determined.

FIG. 10

Cross-genotype and -subtype analysis of the influence of selected mutations on infectivity titers of H77/JFH1 (1a/JFH1) recombinant.

Huh7.5 cells were transfected with recombinants of the different genotypes harbouring the optimal combination of adaptive mutations or adaptive mutations tested across subtypes and major genotypes. The Q1496L mutation (SEQ ID NO: 81 and deduced amino acid sequence SEQ ID NO: 89) was tested for H77/JFH1 in a separate experiment, producing infectivity titers below 10 FFUs/mL. Infectivity titer is shown as FFUs/mL on the indicated days after transfection. n.i.: not infectious

FIG. 11

Cross-genotype and -subtype analysis of the influence of selected mutations on infectivity titers of J4/JFH1 (1b/JFH1) recombinant.

Huh7.5 cells were transfected with recombinants of the different genotypes harbouring the optimal combination of adaptive mutations (left columns) or adaptive mutations tested across subtypes and major genotypes. Infectivity titer is shown as FFUs/mL on the indicated days after transfection. n.i.: not infectious

FIG. 12

Cross-genotype and -subtype analysis of the influence of selected mutations on infectivity titers of S52/JFH1 (3a/JFH1) recombinant.

Huh7.5 cells were transfected with recombinants of the different genotypes harbouring the optimal combination of adaptive mutations as previously identified (left columns) or adaptive mutations tested across subtypes and major genotypes. Infectivity titer is shown as FFUs/mL on the indicated days after transfection. n.i.: not infectious

FIG. 13

Cross-genotype and -subtype analysis of the influence of selected mutations on infectivity titers of ED43/JFH11 (4a/JFH1) recombinant.

Huh7.5 cells were transfected with recombinants of the different genotypes harbouring the optimal combination of adaptive mutations as previously identified (left columns) or adaptive mutations tested across subtypes and major genotypes.

Infectivity titer is shown as FFUs/mL on the indicated days after transfection. n.i.: not infectious.

FIG. 14

Importance of CD81 and SR-BI for entry of intergenotypic viruses.

6×10³ Huh7.5 cells per well of a 96 well plate were treated for 1 hr with either anti-CD81 (A) or anti-SR-BI (B) at the indicated concentrations. ~150 FFU of the respective virus were added for 3 hrs. Virus stocks shown in Table 3 were used. After 48 hrs, the number of FFU was evaluated following immunostaining for HCV NS5A. % inhibition was calculated by relating the number of FFU/well to the mean number of FFU/well of 3 untreated wells. Means of triplicates and standard errors of the mean are shown. Control antibody preparations specified in Materials and Methods did not show any inhibitory effect at the equivalent concentrations. Stars, value <0. Data shown in B were generated in three different experiments (1st experiment: 1:10, 1:40 and 1:160 dilutions (1:160 not shown); 2nd experiment: 1:160 and 1:640 dilutions; 3rd experiment: all dilutions for J4/JFH1$_{F886L,Q21496L}$ viruses). The efficient blocking of infection of the different genotype recombinants with anti-SR-BI was confirmed in an independent experiment (data not shown). The apparent genotype specific differences seen at 1:160 dilution were only reproducible in 2 of 3 independent experiments.

FIG. 15

Treatment of intergenotypic viruses of genotype 1, 2 and 6 with putative antivirals.

4×10⁵ Huh7.5 cells, derived on day 5 of the kinetic experiment (FIG. 2), were plated in 6 well dishes (−12 hrs). After 12 hrs, cell were treated at 0, 6, 12, 24, 48 and 72 hrs with 500 IU/mL interferon-α2b (A, B), 20 µM ribavirin (C, D) or 50 µM amantadine (E, F), respectively. At the indicated time points, percentage of HCV NS5A positive cells was determined using immunostaining and fluorescence microscopy (A, C, E); supernatant HCV RNA titers were measured by Real-Time RT-PCR (B, D, F).

FIG. 16

Comparative kinetics studies of intergenotypic viruses of genotypes 1, 2 and 6.

Huh7.5 cells were inoculated with the respective stock virus (Table 3) for 6 hrs (MOI 0.003); J4/JFH1$_{F886L,Q21496L}$ was from a different virus stock. (A) After immunostaining, the percentage of HCV NS5A positive cells was scored by fluorescence microscopy. (B) Supernatant HCV RNA titers were measured by Real-Time RT-PCR. (C, D) Average content of intracellular HCV Core and NS5A was determined by confocal microscopy based quantitative image analysis after immunostaining for the respective antigen. For each culture and antigen, 3 image stacks were acquired, each comprising an average of 110 cells. Average content of HCV antigen per cell was determined for each image using Imaris 6.1.0 software. Means of the 3 datasets are shown. AU, arbitrary units. None-infected negative control cells are not shown; for Core stainings, a background signal of 2.5 Log$_{10}$, AU (mean of 12 determinations) was recorded, whereas NS5A did not show a background signal.

FIG. 17

Average content of intracellular lipids during infection with genotype 1, 2 and 6 viruses.

At day 3, 5, 7, and 10 after infection (FIG. 2) with the indicated JFH1-based recombinants, 5×10⁴ Huh7.5 cells of the respective cultures were plated on chamber slides. After 24 hrs, lipid droplets were stained with oil-red 0, HCV antigen was stained with either anti-Core or anti-NS5A antibodies, and cell nuclei were stained with Hoechst reagent. For each culture, 6 image stacks were acquired, each of them comprised of on average 110 cells, using confocal microscopy imaging. Average content of lipids per cell was determined for each image using Imaris 6.1.0 software. Means and SEM of the 6 datasets are shown. AU, arbitrary units. Star, time points not analysed.

FIG. 18

Co-localization of HCV antigens with lipid droplets.

At day 5 after infection (FIG. 2) with the indicated JFH1-based recombinants, 5×10⁴ Huh7.5 cells of the respective cultures were plated on chamber slides. After hrs, lipid droplets were stained with oil-red 0, HCV antigen was stained with either anti-Core or anti-NS5A antibodies, and cell nuclei were stained with Hoechst reagent. For each culture and antigen, 4 image stacks were acquired, each comprising >20 cells, using confocal microscopy imaging. Average % of co-localization was determined for each image stack using Imaris 6.1.0. Means and SEM of the 4 datasets are shown. Low % of co-localization of Core with lipids for the none-infected culture is due to a background signal observed in Core stainings.

FIG. 19

Transfection of DBN/JFH1 and S52/JFH1 genomes.

4×10⁵ Huh7.5 cells were plated per well of a 6 well dish and after 24 hrs transfected with 2.5 µg RNA transcripts of DBN/JFH1, DBN/JFH1(A4553C) and DBN/JFH1(C2721G; A4553C) (nucleotide positions refer to DBN/JFH1 sequence); the negative control S52/JFH1(GND); and the positive controls S52/JFH1(A4550C) and S52/JFH1(T2718G; A4550C) (nucleotide positions refer to S52/JFH1 sequence). Percentages of HCV Core antigen expressing cells were determined by immunostaining and confocal microscopy.

FIG. 20

Infectivity titers of DBN/JFH1 and S52/JFH1 transfection supernatants.

6×10³ Huh7.5 cells were plated in replicate wells of a 96-well plate and infected with 10-fold dilutions of cell free cell culture supernatant derived from cultures infected with the indicated virus. HCV NS5A antigen positive cells were evaluated, and TCID50 values were calculated as described previously. For DBN/JFH1 day 6 and S52/JFH1(GND) day 3, 6, and 10, 6/6 replicate wells inoculated with 1000 of undiluted supernatant remained uninfected. For DBN/JFH1 day 10, 1/6 replicate wells was infected.

FIG. 21

First passage of DBN/JFH1 and S52/JFH1 viruses.

4×10⁵ Huh7.5 cells were plated per well of a 6 well dish and after 24 hrs infected with 1 ml cell free supernatant derived from transfection cultures of DBN/JFH1 (day 15), DBN/JFH1(A4553C) (day 10) and DBN/JFH1(C2721G; A4553C) (day 10); the negative control S52/JFH1(GND) (day 10); and the positive controls S52/JFH1(A4550C) and S52/JFH1(T2718G; A4550C) (both day 6). Percentages of HCV Core antigen expressing cells were determined by immunostaining and confocal microscopy.

FIG. 22

Cross-genotype, -isolate and -subtype analysis of the influence of selected mutations on infectivity titers.

(A, B) Cross-genotype and -subtype analysis of the influence of selected mutations on infectivity titers of (A) H77/

JFH1 (1a/JFH1) and J4/JFH1 (1b/JFH1), (B) S52/JFH1 (3a/JFH1) recombinants. (C) Cross-isolate analyses of the influence of selected mutations on infectivity titers of TN/JFH1 (1a/JFH1) recombinant Supernatant harvested on day 10 of transfection experiments showed in FIGS. 10, 11 (A), 12 (B) and 9 (C) were used for infection of naïve Huh7.5 cells. Infectivity titers in 1st passage at selected days post infection are shown. Infectivity titer is shown as FFUs/mL.

FIG. 23

Transfection of Huh7.5 cells with TN/JFH1 and DBN/JFH1 recombinants with putative adaptive mutations.

RNA transcripts from (A) pH77C/JFH1 (V787A, Q1247L), pTN/JFH1 (D1431N), pTN/JFH1 (E1699G) and pTN/JFH1 (D1431N, E1699G) or (B) pS52/JFH1 (I793S, K1404Q), pDBN/JFH1 (T1096A), pDBN/JFH1 (T2327A), pDBN/JFH1 (T1096A, T2327A) and pDBN/JFH1 (W845R, K1405Q) were transfected into Huh7.5 cells.

After immunostaining, the percentage of HCV Core positive cells was scored using confocal fluorescence microscopy.

FIG. 24

Cross-isolate analysis of (A) 1a and (B) 3a adaptive mutations on infectivity titers.

The figures show infectivity titers after transfection of Huh7.5 cells with TN/JFH1 and DBN/JFH1 recombinants with putative adaptive mutations.

RNA transcripts from (A) pH77/JFH1 V787A/Q1247L, pTN/JFH1 D1431N, pTN/JFH1 E1699G, pTN/JFH1 D1431N/E1699G or (B) pS52/JFH1 I793S/K1404Q, pDBN/JFH1 T1096A, pDBN/JFH1 T2327A, pDBN/JFH1 T1096A/T2327A and pDBN/JFH1 W845R/K1405Q were transfected into Huh7.5 cells. FFU determinations on transfection supernatants are shown. #: Not infectious.

FIG. 25

Cross-genotype and -subtype analysis.

Cross-genotype and -subtype analysis of the influence of selected mutations on infectivity titers of (A) TN/JFH1 (1a/JFH1) and (B) DBN/JFH1 (3a/JFH1) recombinants.

Supernatant harvested on day 8 of transfection experiments showed in FIGS. 23 and 24 was used for infection of Huh7.5 cells. Infectivity titers in 1st passage at selected days post infection are shown. Infectivity titer is shown as FFUs/mL.

TABLES

TABLE 1

Mutations of H77C/JFH1 in Huh7.5 cells.

| HCV gene Nucleotide number[†] | | Core | E1 | p7 | NS2 | NS3 | | | | NS4B | NS5A | | | |
|---|---|---|---|---|---|---|---|---|---|---|---|---|---|---|
| H77C/JFH1 | | 791 | 1421 | 2700 | 2887 | 4080 | 4274 | 4562 | 5161 | 6039 | 6352 | 6846 | 7102 | 7375 |
| H77 abs ref | | 792 | 1422 | 2701 | 2888 | 4081 | 4275 | 4563 | 5162 | 6040 | 6353 | 6847 | 7115 | 7387 |
| pH77C/JFH | | C | T | T | T | A | A | C | G | C | C | A | A | C |
| Original constructs | Passage | | | | | | | | | | | | | |
| H77C/JFH1 exp. 1 | 1st | • | • | C/t | • | T | • | • | • | C/g | C/g | • | A/t | A |
| H77C/JFH1 exp. 1 | 2nd | • | T/c | C/t | • | T | • | • | T | G/c | C/G | • | T/a | A |
| H77C/JFH1 exp. 2 | 1st | • | • | • | • | • | • | T | • | • | • | • | • | • |
| Mutated constructs | | | | | | | | | | | | | | |
| H77C/JFH1$_{V787A}$ | 1st | T | • | C | C | • | G | • | • | • | • | • | C | • | • |
| H77C/JFH1$_{Q1247L}$ | 1st | • | • | C | • | T | • | • | • | • | • | • | • | • |
| H77C/JFH1$_{V787A,Q1247L}$ | 1st | • | • | C | • | T | • | • | • | • | • | • | • | • |
| H77C/JFH1$_{R1408W}$ | 1st | • | • | • | • | • | • | T | • | • | • | • | • | • |
| Amino acid | | | | | | | | | | | | | | |
| H77C/JFH1 | | | 361 | 787 | | 1247 | 1312 | 1408 | 1607 | 1900 | | 2169 | | |
| H77 abs ref | | | 361 | 787 | | 1247 | 1312 | 1408 | 1607 | 1900 | | 2169 | | |
| Change | | | Y→H | V→A | | Q→L | I→V | R→W | M→I | A→G | | D→A | | |

[†]Positions are numbered according to the HCV sequence of pH77C/JFH1. Corresponding H77 reference positions (AF009606) are given. Mutations representing >50% of the direct sequence read in at least one passage are shown. Dots indicate identity with the original plasmid sequence. Positions with mixtures are written with the dominant sequence in capital and the minor sequence in lower case letters. Highlighted positions are mutations engineered into H77C/JFH1.

TABLE 2

Coding nucleotide changes of original and adapted J4/JFH1 recombinants in Huh7.5 cells.

| HCV gene | | E2 | E2 | NS2 | NS2 | NS2 | NS3 | NS3 | NS3 | NS4A | NS5A | NS5A | NS5A | NS5A | NS5A | NS5B | NS5B |
|---|---|---|---|---|---|---|---|---|---|---|---|---|---|---|---|---|---|
| Nucleotide number † | | | | | | | | | | | | | | | | | |
| J4/JFH1 | | 1962 | 2067 | 2937 | 2996 | 2997 | 4274 | 4562 | 4827 | 5429 | 6674 | 6840 | 6893 | 7113 | 7148 | 7790 | 9005 |
| H77 abs ref | | 1963 | 2068 | 2938 | 2997 | 2998 | 4275 | 4563 | 4828 | 5430 | 6675 | 6841 | 6894 | 7126 | 7160a | 7737 | 8952 |
| pJ4/JFH1 | | A | A | T | T | T | A | C | A | G | A | A | A | A | T | T | G |
| Original constructs | Passage (day) | | | | | | | | | | | | | | | | |
| J4/JFH1, exp. 1 | 1st (20) | • | • | • | C | • | • | • | T | • | • | • | • | • | • | C | • |
| J4/JFH1, exp. 1 | 2nd (9) | • | G | • | C | • | • | • | T | • | • | • | A/G | • | • | C | G/A |
| J4/JFH1, exp. 2 | transf. (95) | • | • | • | • | C | • | • | • | • | G | T | • | G | C | • | • |
| Mutated constructs | | | | | | | | | | | | | | | | | |
| J4/JFH1 F886L | 1st (8) | • | • | • | C | • | A/G | • | T | • | • | • | • | • | • | • | • |
| J4/JFH1 Q1496L | 1st (15) | G | G | • | G | • | • | • | • | • | • | • | • | • | • | • | • |
| J4/JFH1 S2484P | transf. (64) | • | • | T/C | A | • | • | T | • | A | • | • | • | • | • | C | • |
| J4/JFH1 F886L,Q1496L, exp. 1# | 1st (12) | • | • | • | C | • | • | • | T | • | • | • | • | • | • | • | • |
| J4/JFH1 F886L,Q1496L, exp. 1# | 1st (16) | • | • | • | C | • | • | • | T | • | • | • | • | • | C | • | • |
| J4/JFH1 F886L,Q1496L,S2484P, exp. 1# | 1st (11) | • | • | • | C | • | • | • | T | • | • | • | • | • | • | C | • |
| J4/JFH1 F886L,Q1496L,S2484P, exp. 1# | 1st (10) | • | G | • | C | • | • | • | T | • | • | • | • | • | • | C | • |
| Amino acid position † | | | | | | | | | | | | | | | | | |
| J4/JFH1 | | 541 | 576 | 866 | 886 | 886 | 1312 | 1408 | 1496 | 1697 | 2112 | 2167 | 2185 | 2258 | 2270 | 2484 | 2889 |
| H77 abs ref | | 541 | 576 | 866 | 886 | 886 | 1312 | 1408 | 1496 | 1697 | 2112 | 2167 | 2185 | 2262 | 2274 | 2466 | 2871 |
| Change | | N→S | N→S | V→A | * | F→S | I→V | R→W | Q→L | D→N | I→V | D→V | T→A | E→G | C→R | S→P | V→I |

†Positions are numbered according to the HCV sequence of pJ4/JFH1. Corresponding H77 (AF009606) absolute reference positions are given. Coding mutations are shown. Dots indicate identity with the original plasmid sequence. Positions with mixtures are written with the dominant sequence in capital and the minor sequence in lower case letters (a 50/50 quasispecies is shown as two capital letters). Highlighted positions are mutations engineered into J4/JFH1. In addition, the following non-coding mutations were found: J4/JFH1 (exp.1) 1st (Day 20) A3175A/C, C4972C/T, A8047G/a; J4/JFH1 (exp.1) 2nd (Day 9) A3175C/a, C4972C/T, T5752C, A8047G; J4/JFH1 (exp.2) transf. (Day 95) A3403G; J4/JFH1 F886L 1st (Day 8) G6148A; J4/JFH1 Q1496L 1st (Day 15) C7331C/T; J4/JFH1 S2484P transf. (Day 64) C4582T; J4/JFH1 F886L, Q1496L, S2484P (exp.1) 1st (Day 16) C5404T; J4/JFH1 F886L, Q1496L, S2484P (exp.1) 1st (Day 10) T2075C.
Data was derived from 2 different 1st passages of the same transfection experiments. J4/JFH1 F886L, Q1496L (exp. 1) 1st (Day 16) is the virus stock.
*Amino acid change F → L/V/I encoded by nucleotide change T → C/G/A.

TABLE 3

Cross-genotype neutralization potential of chronic phase genotype 1a, 4a and 5a serum against genotype 1-7 recombinant viruses.

| Core-NS2 | Reciprocal 50% serum neutralizing antibody titer | | |
|---|---|---|---|
| Genotype | 1a (H06) | 4a (AA) | 5a (SA3) |
| 1a | 1600 | <100* | <100 |
| 1b | 800 | <100* | <100* |
| 2a | <100* | <100** | <100 |
| 2b | 3200 | 400 | 200 |
| 3a | <100* | <100** | <100 |
| 4a | 12800 | 6400 | 200 |
| 5a | 25600 | 3200 | 6400 |
| 6a | 204800 | 25600 | 12800 |
| 7a | 25600 | 3200 | 1600 |

Neutralization of genotype 1a, 2a, 3a, 4a, 5a and 6a viruses with 1a (H06), 4a (AA) and 5a (SA3) chronic phase serum was described previously. Similarly, approximately 150 FFU of J4/JFH1$_{F886L,Q21496L}$, 80 or 150 FFU of J8/JFH1, and 30 FFU of QC69/JFH1 stock viruses were pre-incubated with 2-fold dilutions of sera in triplicates, before infection of 6×10$^3$ Huh7.5 cells for 3 hrs. After 48 hrs incubation, the number of FFUs was determined for each culture by anti-NS5A immunostaining. 50% neutralization titers indicate the serum dilution, which led to an at least 50% reduction of FFU compared to the mean of 6 non-serum treated cultures. * 50% neutralization observed at 1:50 serum dilution; ** less than 50% neutralization observed at 1:50 serum dilution.

TABLE 5

Mutations selected for cross-genotype, -subtype and -isolate analyses:

| Position[1] | Mutation | Gene | Previously identified in recovered viruses | Previously identified as single adaptive mutation in reverse genetic studies |
|---|---|---|---|---|
| 787 | [2] | p7 | 1a/JFH and 3a/JFH1 | 3a/JFH1 |
| 1247 | Q → L | NS3 | 1a/JFH1 | 1a/JFH1 |
| 1312 | I → V | NS3 | 1a/JFH1, 1b/JFH1, 5a/JFH1 and JFH1 | |
| 1398 | K → Q | NS3 | 3a/JFH1 | 3a/JFH1 |
| 1408 | R → W | NS3 | 1a/JFH1 and 1b/JFH1 | 1a/JFH1 |
| 1496 | Q → L | NS3 | 1b/JFH1 and 3a/JFH1 | |
| 2418 | V → L | NS5A | 4a/JFH1 and JFH1 | 1a/JFH1, 1b/JFH1, 3a/JFH1 and JFH1 |

[1]Numbers used throughout refer to H77 reference (AF009606) amino acid sequence.
[2] V → A for 1a/JFH1, I/T → S for 3a/JFH1. Position 787 included in isolate analysis only.

TABLE 4

Primers and primer sequences used for generation of amplicons for sequencing as described in Materials and Methods.

| Primer pair | Forward | SEQ ID NO | 5'-3' Sequence | Reverse | SEQ ID NO | 5'-3' Sequence |
|---|---|---|---|---|---|---|
| H77/JFH1 | | | | | | |
| 1 | -84S_HCV-MOD | 45 | GTAGCGTTGGGTTGCGAAAGG CCTTGTGGTACTGCCTGAT | 1abR1321 | 49 | GACCAGTTCATCATCATATCCC |
| 2 | 1aF965 | 46 | AACTCGAGTATTGTGTACGAGGCGGCC | 1aR2038 | 50 | CGCTCCGCACACTTTGGTG |
| 3 | 1aF1910 | 47 | GGCGCGCCTACCTACAGCTGGGG | 1aR2815 | 51 | CAGAGTCAGCGCCATTAACC |
| 4 | 1abF2729 | 48 | CTCCTGCTCCTGCTGGCG | 3329R_JFH1-MOD | 52 | CCCTCAGCACTCGAGTACATCTG |
| TN/JFH1 | | | | | | |
| 1 | -84S_HCV-MOD | 45 | GTAGCGTTGGGTTGCGAAAGGC CTTGTGGTACTGCCTGAT | 1abR1321 | 49 | GACCAGTTCATCATCATATCCC |
| 2 | TNF965 | 57 | AACTCGAGCATTGTGTTCGAGGCGGC | 1aR2038 | 50 | CGCTCCGCACACTTTGGTG |
| 3 | 1aF1910 | 47 | GGCGCGCCTACCTACAGCTGGGG | 1aR2815 | 51 | CAGAGTCAGCGCCATTAACC |
| 4 | TNF2729 | 58 | CTCCTGCTCCTGCTGGCG | 3329R_JFH1-MOD | 52 | CCCTCAGCACTCGAGTACATCTG |
| J4/JFH | | | | | | |
| 1 | -84S_HCV-MOD | 45 | GTAGCGTTGGGTTGCGAAA GGCCTTGTGGTACTGCCTGAT | 1abR1321 | 49 | GACCAGTTCATCATCATATCCC |
| 2 | 1bF965 | 53 | AACTCAAGCATTGTGTATGAGGCAGCG | 1bR1995 | 55 | CAGCCGAACCAGTTGCCTTG |
| 3 | 1bF1910 | 54 | GGTGTCCCTACGTATAGCTGGGG | 1bR2815 | 56 | CAAGGTCAAGAGTGCCAGAC |
| 4 | 1abF2729 | 48 | CTCCTGCTCCTGCTGGCG | 3329R_JFH1-MOD | 52 | CCCTCAGCACTCGAGTACATCTG |
| JFH1 | | | | | | |
| 5 | 3081S_J6/JFH1 | 59 | GGAGTCTTCTCGCTCCCATCACTGC | 4118R_JFH1 | 67 | CGCCCGAGGCCTACCTCTTCTATATC |
| 6 | 3880S_J6 | 60 | CCCATCACGTACTCCACATATGGC | 4796R_JFH1 | 68 | GCGCACACCGTAGCTTGGTAGG |
| 7 | 4528S_J6 | 61 | GAGCGAGCCTCAGGAATGTTTGACA | 5446R_JFH1 | 69 | TGATGTTGAGAAGGATGGTGGTAC |
| 8 | 5272S_JFH1 | 62 | TGGCCCAAAGTGGAACAATTTTG | 6460R_J6 | 70 | CAACGCAGAACGAGACCTCATCCC |
| 9 | 6186S_JFH1 | 63 | GACCTTTCCTATCAATTGCTACAC | 7234R_JFH1 | 71 | GAAGCTCTACCTGATCAGACTCCA |
| 10 | 6862S_JFH1 | 64 | TGGGCACGGCCTGACTACAA | 7848R_JFH1 | 72 | GGCCATTTCTCGCAGACCCGGAC |
| 11 | 7741S_J6 | 65 | ATGGCCAAAAATGAGGTGTTCTGC | 8703R_JFH1 | 73 | AAGGTCCAAAGGATTCACGGAGTA |
| 12 | 8137S_JFH1 | 66 | GGTCAAACCTGCGGTTACAGACGTTG | 9464R(24)_JFH1 | 74 | GTGTACCTAGTGTGTGCCGCTCTA |

TABLE 6

Genetic stability of mutated recombinants in cross-isolate analysis after passage to naïve cells. Supernatant samples from transfection culture were passaged to naïve Huh7.5 cells and the complete ORF was sequenced after viral spread in culture to check for further need of adaptation.

| HCV gene | | Core | Core | E2 | p7 | NS3 | | | | NS4A | NS4B | NS5A | | |
|---|---|---|---|---|---|---|---|---|---|---|---|---|---|---|
| Nucleotide number[†] | | | | | | | | | | | | | | |
| TN/JFH1 | | 829 | 893 | 1981 | 2700 | 4080 | 4532 | 4562 | 4631 | 5436 | 5556 | 6638 | 6849 | 7137 |
| H77 abs ref | | 830 | 894 | 1982 | 2701 | 4081 | 4533 | 4563 | 4632 | 5437 | 5557 | 6639 | 6850 | 7150 |
| pTN/JFH | | C | C | C | T | A | A | C | G | A | C | T | T | T |
| Original constructs | Passage | | | | | | | | | | | | | |
| TN/JFH1, exp. 1 | transf | • | • | A | • | • | • | • | A | G | • | • | • | • |
| Mutated constructs | | | | | | | | | | | | | | |
| TN/JFH1$_{Q1247L}$ | 1st p | • | • | • | • | T | • | • | • | • | • | • | • | • |
| TN/JFH1$_{R1408W}$ | 1st p | • | • | • | • | • | • | T | • | • | • | • | • | • |
| TN/JFH1$_{V787A,Q1247L}$ | 1st p | • | • | • | C | T | • | • | • | • | • | C/T | T/A | T/C | T/C |
| TN/JFH1$_{D1431N}$ | transf | C/T | C/T | • | • | • | A/C | • | • | A | • | • | • | • |
| TN/JFH1$_{D1431N/E1699G}$ | 1st p | • | • | • | • | • | • | • | • | A | G | • | • | • |
| Amino acid | | | | | | | | | | | | | | |
| TN/JFH1 | | | | 787 | 1247 | 1398 | 1408 | 1431 | 1699 | 1739 | 2100 | 2170 | 2266 | |
| H77 abs ref | | | | 787 | 1247 | 1398 | 1408 | 1431 | 1699 | 1739 | 2100 | 2170 | 2270 | |
| Change | | nc | nc | nc | V→A | Q→L | K→Q | R→W | D→N | E→G | A→V | S→T | V→A | I→T |

[†]Positions are numbered according to the HCV sequence of pTN/JFH1. Corresponding H77 (AF009606) absolute reference positions are given. Coding mutations are shown. Dots indicate identity with the original plasmid sequence. Positions with mixtures are written with the dominant sequence in capital and the minor sequence in lower case letters (a 50/50 quasispecies is shown as two capital letters). Highlighted positions are mutations engineered into TN/JFH1.

TABLE 7

Genetic stability of mutated recombinant H77/JFH1 in cross-genotype and -subtype analysis after passage to naïve cells.

| HCV gene | | | | | | | | | | |
|---|---|---|---|---|---|---|---|---|---|---|
| Nucleotide number[†] | | | | | | | | | | |
| H77C/JFH1 | | 1064 | 2245 | 2700 | 3211 | 4080 | 4274 | 4532 | 4536 | 4562 |
| H77 abs ref | | 1065 | 2246 | 2701 | 3212 | 4081 | 4275 | 4533 | 4537 | 4563 |
| pH77C/JFH | | G | G | T | A | A | A | A | A | C |
| Cross-genotype study | Passage | | | | | | | | | |
| H77C/JFH1$_{V787A,Q1247L}$ | 1st | • | • | C | • | T | • | • | • | • |
| H77C/JFH1$_{Q1247L}$ | 1st | • | G/A | • | • | T | • | • | • | • |
| H77C/JFH1$_{I1312V}$ | 1st | • | • | • | • | • | G | • | A/T | • |
| H77C/JFH1$_{K1398Q}$ | 1st | G/a | • | • | A/G | • | G | C | • | |
| H77C/JFH1$_{R1408W}$ | 1st | • | • | • | • | • | • | T | • | |
| Amino acid | | | | | | | | | | |
| H77C/JFH1 | | 242 | | 787 | | 1247 | 1312 | 1398 | 1399 | 1408 |
| H77 abs ref | | 242 | | 787 | | 1247 | 1312 | 1398 | 1399 | 1408 |
| Change | | V→M | nc | V→A | nc | Q→L | I→V | K→Q | K→M | R→W |

[†]Positions are numbered according to the HCV sequence of pH77/JFH1. Corresponding H77 (AF009606) absolute reference positions are given. Coding mutations are shown. Dots indicate identity with the original plasmid sequence. Positions with mixtures are written with the dominant sequence in capital and the minor sequence in lower case letters (a 50/50 quasispecies is shown as two capital letters). Highlighted positions are mutations engineered into H77/JFH1. nc: non-coding.

TABLE 8

Genetic stability of mutated recombinant J4/JFH1 in cross-genotype and -subtype analysis after passage to naïve cells.

| HCV gene | | E1 | NS2 | NS3 | | | | | | NS4B | | NS5A | | |
|---|---|---|---|---|---|---|---|---|---|---|---|---|---|---|
| Nucleotide number[†] | | | | | | | | | | | | | | |
| J4/JFH1 | | 1032 | 1193 | 2996 | 4080 | 4274 | 4532 | 4562 | 4827 | 6089 | 6758 | 7062 | 7128 | 7649 |
| H77 abs ref | | 1033 | 1194 | 2997 | 4081 | 4275 | 4533 | 4563 | 4828 | 6090 | 6759 | 7075 | 7141 | 7596 |
| pJ4/JFH | | A | T | T | A | A | A | C | A | A | T | A | A | T |
| Cross-genotype study | Passage | | | | | | | | | | | | | |
| J4/JFH1$_{F886L,Q1496L}$ | 1st | • | • | C | • | • | • | • | T | • | • | • | • | • |
| J4/JFH1$_{Q1247L}$ | 1st | G/a | C/t | • | T | • | • | • | • | A/C | C/t | G/a | • | • |
| J4/JFH1$_{I1312V}$ | 1st | • | • | C/T | • | G | • | • | • | • | • | • | • | • |
| J4/JFH1$_{K1398Q}$ | 1st | • | • | • | T/c | • | C | • | • | • | • | • | • | • |
| J4/JFH1$_{R1408W}$ | 1st | • | • | • | • | • | • | T | • | • | • | • | • | • |
| J4/JFH1$_{Q1496L}$ | 1st | • | • | C/T | • | • | • | • | T | • | • | • | G/a | T/A |
| Amino acid | | | | | | | | | | | | | | |
| J4/JFH1 | | 231 | 285 | 886 | 1247 | 1312 | 1398 | 1408 | 1496 | 1917 | 2140 | 2241 | 2263 | 2437 |
| H77 abs ref | | 231 | 285 | 886 | 1247 | 1312 | 1398 | 1408 | 1496 | 1917 | 2140 | 2245 | 2267 | 2419 |
| Change | | Q→R | F→L | F→L | Q→L | I→V | K→Q | R→W | Q→L | N→H | F→L | E→G | E→G | C→S |

[†]Positions are numbered according to the HCV sequence of pJ4/JFH1. Corresponding H77 (AF009606) absolute reference positions are given. Coding mutations are shown. Dots indicate identity with the original plasmid sequence. Positions with mixtures are written with the dominant sequence in capital and the minor sequence in lower case letters (a 50/50 quasispecies is shown as two capital letters). Highlighted positions are mutations engineered into J4/JFH1.

TABLE 9

Genetic stability of mutated recombinants in cross-genotype and -subtype analysis after passage to naïve cells

| Recombinant | Optimal combination | Q1247L | I1312V | K1398Q | R1408W | Q1496L | V2418L |
|---|---|---|---|---|---|---|---|
| H77/JFH1 | Stable | Stable | Not stable | Not stable | Stable | Not tested | # |
| J4/JFH1 | Stable | Not stable | Not stable | Stable | Stable | Not stable | # |
| S52/JFH1 | Stable | Stable | Stable | Stable | Stable | Stable | Stable |
| ED43/JFH1 | Stable | # | # | # | # | # | # |

Day 10 supernatant samples from transfection culture were passaged to naïve Huh7.5 cells (MOI = 0.003) and the complete ORF was sequenced after viral spread in culture to check for further need of adaptation.
: Infectivity titers in transfection experiment not above $10^2$ FFU/mL. Adaptation not investigated.

TABLE 10

Characterization of genotype 1, 2 and 6 kinetic cultures at peak of infection.

| Core-NS2 Genotype | Virus † | Day * | Infection # % | HCV RNA titer ** EC ‡ LOG$_{10}$ IU/mL | IC ## LOG$_{10}$ IU/10$^5$ cells | HCV Infectivity titer& EC ‡ LOG$_{10}$ FFU/mL | IC ## LOG$_{10}$ FFU/10$^5$ cells | Specific infectivity EC ‡ FFU/IU | IC ## FFU/IU | HCV Antigen $ Core/cell LOG$_{10}$ AU | NS5A/cell LOG$_{10}$ | Lipid $ Lipid/cell LOG$_{10}$ |
|---|---|---|---|---|---|---|---|---|---|---|---|---|
| 1a | H77C/JFH1$_{V787A, Q1247L}$ | 7 | 80 | 7.4 | 7.2 | 4.0 | 2.7 | 1/2512 | 1/31623 | 4.9 | 5.5 | 4.3 |
| 1b | J4/JFH1$_{F886L, Q1496L}$ | 7 | 80 | 7.4 | 6.6 | 4.0 | 1.9 | 1/2512 | 1/50119 | 4.9 | 5.5 | 4.4 |
| 2a | J6/JFH1 | 7 | 90 | 8.0 | 7.2 | 5.1 | 2.5 | 1/794 | 1/50119 | 5.5 | 5.7 | 4.0 |
| 2b | J8/JFH1 | 7 | 90 | 7.4 | 7.3 | 4.6 | 2.7 | 1/631 | 1/39811 | 5.2 | 5.5 | 4.3 |
| 6a | HK6a/JFH1$_{F350S, N417T}$ | 7 | 80 | 7.0 | 7.0 | 4.1 | 1.9 | 1/794 | 1/125893 | 5.4 | 5.4 | 4.2 |
| None | None | 7 | 0 | nd | nd | nd | nd | na | na | 3.0 | nd | 4.0 |

Figure 14:
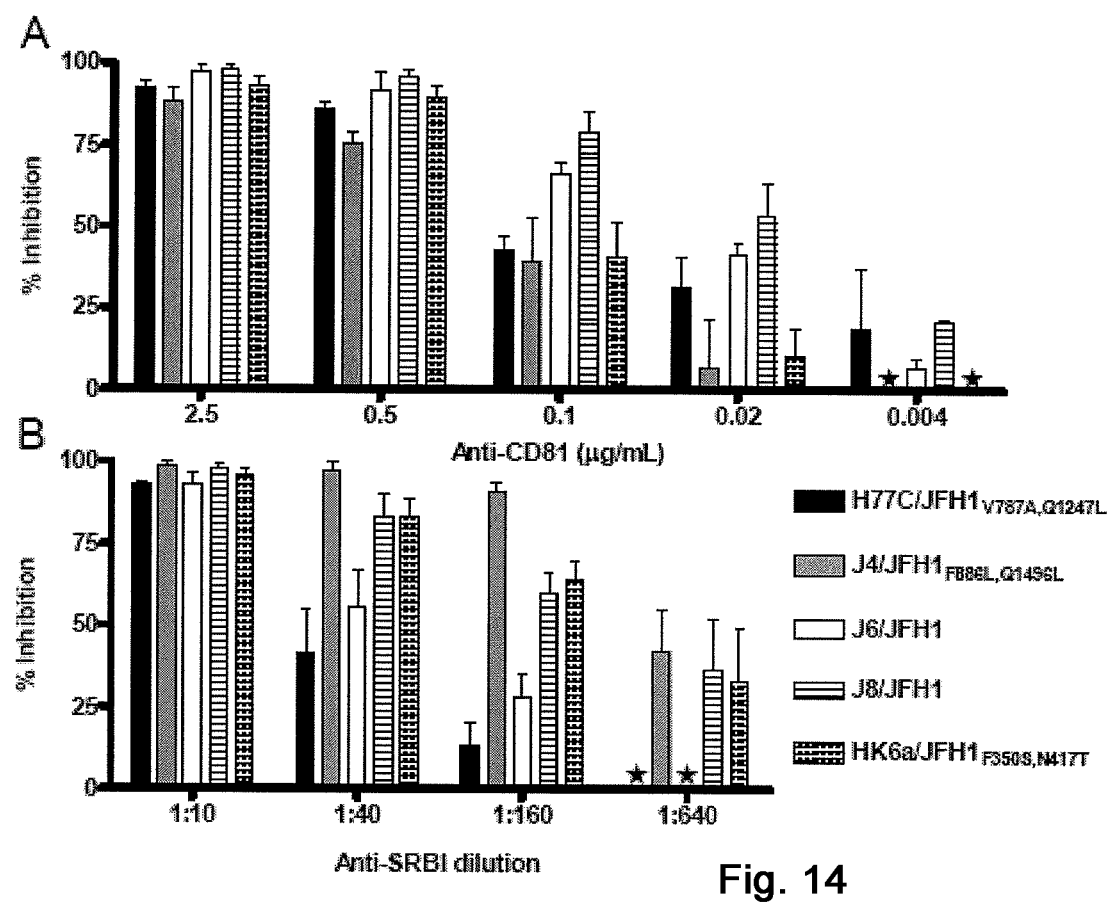

† HCV recombinant with engineered adaptive mutations used in comparative kinetic study (FIG. 14).
* The first time point (day), at which HCV RNA titers in culture supernatant were ≥10$^7$ IU/mL (FIG. 14B).
% infected cells scored using fluorescence microscopy (FIG. 14A).
** IU/mL or IU/10$^5$ cells.

TABLE 11

| Nucleotide/Amino acid changes in cell culture derived DBN/JFH1 genomes. HCV gene Nucleotide number[†] | | E2 | p7 | NS2 | NS3 | NS3 | NS3 | NS4B | NS5A | NS5A |
|---|---|---|---|---|---|---|---|---|---|---|
| DBN/JFH1 | | 1619 | 2721 | 2873 | 3626 | 4553 | 5326 | 5728 | 7199 | 7319 |
| H77 abs ref | | 1620 | 2701 | 2853 | 3606 | 4533 | 5306 | 5708 | 7191 | 7311 |
| pDBN/JFH | | | | | | | | | | |
| Original constructs | Passage | C | C | T | A | A | C | C | G | A |
| DBN/JFH1, exp. 1 | Transfection | • | • | • | G | • | • | • | G/c | G/a |
| Mutated constructs | | | | | | | | | | |
| DBN/JFH1 K1405Q | 1st | • | • | A | • | C | • | • | • | • |
| DBN/JFH1 T794S K1405Q | 1st | • | G | C | • | C | • | • | • | • |
| DBN/JFH1 T1096A | 1st | • | • | • | G | • | • | • | • | • |
| DBN/JFH1 T2327A | Transfection | C/t | • | • | G | • | • | T | • | G |
| DBN/JFH1 T1096A/T2327A | 1st | • | • | • | G | • | C/T | • | • | G |
| DBN/JFH1 T1096A/T2327A | 1st | • | • | • | G | • | • | • | • | G |
| DBN/JFH1 W845R/K1405Q | 1st | • | • | A | • | C | • | • | • | • |
| Amino acid | | | | | | | | | | |
| DBN/JFH1 | 1st | • | 794 | 845 | 1096 | 1405 | | | 2287 | 2327 |
| H77 abs ref | 1st | • | 787 | 838 | 1089 | 1398 | | | 2284 | 2324 |
| Change | | nc | T → S | W → R | T → A | K → Q | nc | nc | A → P | T → A |

[†]Direct sequence analysis was performed on viruses recovered from transfection (FIG. 19 and 20) and the consecutive first viral passage (FIG. 21). Positions are numbered according to the HCV sequence of pDBN/JFH1. Corresponding H77 (AF009606) absolute reference positions are given. Coding mutations are shown. Dots indicate identity with the original plasmid sequence. Positions with mixtures are written with the dominant sequence in capital and the minor sequence in lower case letters (a 50/50 quasispecies is shown as two capital letters). Highlighted positions are mutations engineered into DBN/JFH1

REFERENCES

Gottwein, J. M. et al. (2007) Robust Hepatitis C Genotype 3a Cell Culture Releasing Adapted Intergenotypic 3a/2a (S52/JFH1) Viruses Gastroenterology 133, 1614-1626.

Lindenbach, B. D., Evans, M. J., Syder, A. J., Wolk, B., Tellinghuisen, T. L., Liu, C. C., Maruyama, T., Hynes, R. O., Burton, D. R., McKeating, J. A., and Rice, C. M. (2005). Complete replication of hepatitis C virus in cell culture. Science. 309, 623-626.

Sakai et al. (2007). In Vivo Study of the HC-TN Strain of Hepatitis C Virus Recovered from a Patient with Fulminant Hepatitis: RNA Transcripts of a Molecular Clone (pHC-TN) Are Infectious in Chimpanzees but Not in Huh7.5 Cells. Journal of Virology 81(13): 7208-19.

Simmonds et al. 2005. Consensus proposal for unified system of nomenclature of hepatitis C virus genotypes. Hepatology, 42(4): 962-73.

Bukh J, Purcell R H, Miller R H. At least 12 genotypes of hepatitis C virus predicted by sequence analysis of the putative E1 gene of isolates collected worldwide. Proc Natl Acad Sci USA 1993; 90:8234-8238.

SEQUENCE LISTING (96 sequences)

SEQ ID NO: 1 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 2 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 3 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 4 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 5 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 6 - protein, 3048 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPARLFGLLLLFVGVGLFLLPAR

SEQ ID NO: 7 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 8 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 9 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 10 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggccctttggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 11 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacgtcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 12 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 13 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 14 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 15 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgccccacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 16 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 17 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaattcttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgccccacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 18 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 19 - DNA, 9666 bp, Hepatitis C virus; identical to SEQ ID NO: 3

SEQ ID NO: 20 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacgtcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 21 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacgtcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggccctttggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 22 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 23 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggccctttggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 24 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggcctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgccctggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 25 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 26 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAAYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 27 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 28 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALWGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 29 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDVIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 30 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 31 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 32 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 33 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKPASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 34 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 35 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELILDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSAPQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 36 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 37 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDVIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 38 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 39 - protein, 3029 aa, Hepatitis C virus
MSTNPKPQRKTKRNTNRRPQDVKFPGGGQIVGGVYLLPRRGPRLGVRATRKASERSQPRGRRQPIPKARRPEGRAWAQPGYPWPLYGNEGLGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTIPASAYEVRNVSGIYHVTNDCSNSSIVYEAADVIMHTPGCVPCVQEGNSSRCWVALTPTLAARNASVPTTTIRRHVDLLVGTAAFCSAMYVGDLCGSIFLVSQLFTFSPRRHETVQDCNCSIYPGHVSGHRMAWDMMMNWSPTTALVVSQLLRIPQAVVDMVAGAHWGVLAGLAYYSMVGNWAKVLIVALLFAGVDGETHTTGRVAGHTTSGFTSLFSSGASQKIQLVNTNGSWHINRTALNCNDSLQTGFFAALFYAHKFNSSGCPERMASCRPIDWFAQGWGPITYTKPNSSDQRPYCWHYAPRPCGVVPASQVCGPVYCFTPSPVVVGTTDRSGVPTYSWGENETDVMLLNNTRPPQGNWFGCTWMNSTGFTKTCGGPPCNIGGVGNRTLICPTDCFRKHPEATYTKCGSGPWLTPRCLVDYPYRLWHYPCTLNFSIFKVRMYVGGVEHRLNAACNWTRGERCNLEDRDRSELSPLLLSTTEWQILPCAFTTLPALSTGLIHLHQNIVDVQYLYGVGSAFVSFAIKWEYILLLFLLLADARVCACLWMMLLIAQAEAALENLVVLNAASVAGAHGILSFLVFFCAAWYIKGRLAPGAAYAFYGVWPLLLLLLALPPRAYALDREMAASCGGAVLVGLVFLTLSPYYKVFLTRLIWWLQYFITRAEAHMQVWVPPLNVRGGRDAIILLTCAVHPELIFDITKLLLAILGPLMVLQAGITRVPYFVRAQGLIRACMLVRKVAGGHYVQMVFMKLGALTGTYVYNHLTPLRDWAHAGLRDLAVAVEPVVFSAMETKVITWGADTAACGDIILGLPVSARRGKEIFLGPADSLEGQGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALWGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 40 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 41 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALWGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 42 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAAYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAALGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 43 - DNA, 30 bp, Hepatitis C virus
actgtcttcacgcagaaagcgcctagccat

SEQ ID NO: 44 - DNA, 24 bp, Hepatitis C virus
ctatggagtgtacctagtgtgtgc

SEQ ID NO: 45 - DNA, 40 bp, Hepatitis C virus
gtagcgttgggttgcgaaaggccttgtggtactgcctgat

SEQ ID NO: 46 - DNA, 27 bp, Hepatitis C virus
aactcgagtattgtgtacgaggcggcc

SEQ ID NO: 47 - DNA, 23 bp, Hepatitis C virus
ggcgcgcctacctacagctgggg

SEQ ID NO: 48 - DNA, 18 bp, Hepatitis C virus
ctcctgctcctgctggcg

SEQ ID NO: 49 - DNA, 22 bp, Hepatitis C virus
gaccagttcatcatcatatccc

SEQ ID NO: 50 - DNA, 19 bp, Hepatitis C virus
cgctccgcacactttggtg

SEQ ID NO: 51 - DNA, 20 bp, Hepatitis C virus
cagagtcagcgccattaacc

SEQ ID NO: 52 - DNA, 23 bp, Hepatitis C virus
ccctcagcactcgagtacatctg

SEQ ID NO: 53 - DNA, 27 bp, Hepatitis C virus
aactcaagcattgtgtatgaggcagcg

SEQ ID NO: 54 - DNA, 23 bp, Hepatitis C virus
ggtgtccctacgtatagctgggg

SEQ ID NO: 55 - DNA, 20 bp, Hepatitis C virus
cagccgaaccagttgccttg

SEQ ID NO: 56 - DNA, 20 bp, Hepatitis C virus
caaggtcaagagtgccagac

SEQ ID NO: 57 - DNA, 26 bp, Hepatitis C virus
aactcgagcattgtgttcgaggcggc

SEQ ID NO: 58 - DNA, 18 bp, Hepatitis C virus
ctcttgctcctgttagcg

SEQ ID NO: 59 - DNA, 25 bp, Hepatitis C virus
ggagtcttctcgctcccatcactgc

SEQ ID NO: 60 - DNA, 24 bp, Hepatitis C virus
cccatcacgtactccacatatggc

SEQ ID NO: 61 - DNA, 25 bp, Hepatitis C virus
gagcgagcctcaggaatgtttgaca

SEQ ID NO: 62 - DNA, 24 bp, Hepatitis C virus
tggcccaaagtggaacaattttgg

SEQ ID NO: 63 - DNA, 24 bp, Hepatitis C virus
gacctttcctatcaattgctacac

SEQ ID NO: 64 - DNA, 20 bp, Hepatitis C virus
tgggcacggcctgactacaa

SEQ ID NO: 65 - DNA, 24 bp, Hepatitis C virus
atggccaaaaatgaggtgttctgc

SEQ ID NO: 66 - DNA, 26 bp, Hepatitis C virus
ggtcaaacctgcggttacagacgttg

SEQ ID NO: 67 - DNA, 26 bp, Hepatitis C virus
cgcccgaggcctacctcttctatatc

SEQ ID NO: 68 - DNA, 22 bp, Hepatitis C virus
gcgcacaccgtagcttggtagg

SEQ ID NO: 69 - DNA, 24 bp, Hepatitis C virus
tgatgttgagaaggatggtggtac

SEQ ID NO: 70 - DNA, 24 bp, Hepatitis C virus
caacgcagaacgagacctcatccc

SEQ ID NO: 71 - DNA, 24 bp, Hepatitis C virus
gaagctctacctgatcagactcca

SEQ ID NO: 72 - DNA, 24 bp, Hepatitis C virus
ggccattttctcgcagacccggac

SEQ ID NO: 73 - DNA, 24 bp, Hepatitis C virus
aaggtccaaaggattcacggagta

SEQ ID NO: 74 - DNA, 24 bp, Hepatitis C virus
gtgtacctagtgtgtgccgctcta

SEQ ID NO: 75 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 76 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 77 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgagctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 78 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 79 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 80 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVSYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 81 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagactgggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 82 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggaaatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 83 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataagggggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 84 - DNA, 9666 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaatgagggttgcgggtgggcgggatggctcctgtctccccgtggctctcggcctagctggggccccacggacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttttggaagacggcgtgaactatgcaacagggaaccttcctggttgctctttctctattttccttctggccctgctctcttgtctgactggacccgcttcagcctaccaagtgcgcaactccacggggctttaccatgtcaccaatgattgccccaactcgagcattgtgttcgaggcggctgatgccatcctgcacactccggggtgtgtcccttgcgtacgcgagggtaacgcctcgaggtgttgggtggcggtaacccccacggtggccaccagggatggcaaactccccacaacgcagcttcgacgtcacatcgatctgcttgtcgggagcgccaccctctgctcggccctttacgtgggggacctgtgcgggtctgtctttcttgttggtcaactgttcaccttctctcccaggcgccactggacgacgcaagattgcaattgttctatctaccccggccatatttcaggtcaccgtatggcatgggatatgatgatgaactggtcccctacggcggcgttgttggtagctcagctgctccggatcccacaagccatcctggacatgatcgctggtgctcactggggagtcctggcgggcatggcgtatttctccatggtggggaactgggcgaaggttctggtagtgctgctgctatttgccggcgtcgacgcggaaacctacgtcaccgggggaagtgccgcccgtactacggctggacttgctagtcttttctcaccaggcgccaagcagaacatccagctggtcaacaccaacggcagttggcacatcaatagcacggccttgaactgcaatgacagcctcaacaccggctggatagcaggacttttctatcaccacaaattcaactcttcgggctgttccgagaggttagccagctgccgaccccttaccgattttgcccagggctggggccctatcagtcacgccgacggaagtggccccgaccaacgcccctactgctggcactaccctccaaaaccttgtggtattgtgcccgcaaagagcgtgtgtggcccggtatattgtttcactcccagtcccgtggtggtgggaacgaccgacaggtcgggcgcgcctacctacagctggggtgcaaatgacacggacgtcttcgtccttaacaacaccaggccaccgctgggcaattggttcggttgcacctggatgaactcaactggattcaccaaagtgtgcggagcgcccccttgcgtcatcggaggggtgggcaacaacaccttgcgctgccccactgattgtttccgcaagcatccggaagccacatactctcggtgcggctccggtccctggattacgcccaggtgcctggtcgactacccgtataggctttggcattatccttgtaccatcaactacaccgtgtttaaagtcaggatgtacgtgggaggggtcgagcacaggctggaagctgcctgcaactggacgcggggcgaccgttgtaatctggatgacagggacaggtccgagctcagcccgctgctgctgtccactacgcagtggcaggtcctcccgtgttccttcacgaccctgccagccttgtccaccggcctcatccacctccaccaaaacatcgtggacgtgcaatacttgtacggggtgggatcaagcatcgcgtcctgggccatcaagtgggaatacgtcgttctcttgttccttctgcttgcagacgcgcgcgtctgctcctgcttgtggatgatgttactcatatcccaagtggaggcggctttggagaacctcgtagtactcaatgcagcatccctggccgggacacacggtcttgtatccttcctcgtgttcttctgctttgcatggtatctgaagggtaagtgggtgcccggagcggtctacgccctctacgggatgtggcctctcctcttgctcctgttagcgttgccccagcgggcatacgcactggacacggaggtggccgcgtcgtgtggcggcgttgttcttgtcgggttaatggcgctgactctgtcaccatattacaagcgctatatcagctggtgcttgtggtggcttcagtatttcctgaccagaatagaagcgcaactgcacgtgtggattccccctctcaacgtccggggggggcgcgatgccgtcatcttactcatgtgtgttgtgcacccggctctggtatttgacatcaccaagctactgctggctgccttcgggcccctttggattcttcaagccagtttgcttaaggtaccctacttcgtgcgcgttcaaggccttctccggatctgcgcgctagcgcggaagatggctggaggccattacgtgcaaatggccatcatcaagttaggggcgcttactggcacttatgtttacaaccatctcaccccccttcgggactgggcgcacaacggcctgcgagatctggccgtggctgtggagccagtcgtcttctcccgaatggagaccaagcttatcacctggggggcagacaccgccgcgtgcggtgacatcatcaacggcttgcccgtctccgcccggaggggccgggagatactgctcgggccagccgatggaatggtctccaaggggtggagattgctggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggaaatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataagggggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 85 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaaggctctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 86 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccggcgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 87 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcattggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaaggctctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccggcgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 88 - DNA, 9687 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacacttcctaaacctcaaagaaaaaccaaaagaaacaccatccgccgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccctggcccctctatggtaacgagggctgcgggtgggcagggtggctcctgtccccacgcggttcccgcccatcttggggcccgaacgacccccggcgaaggtcccgcaatttgggtaaggtcatcgataccctcacgtgtggattcgccgacctcatggggtacatcccgctcgtcggcgctcccgtagggggcgtcgcaagggcccttgcgcatggcgtgagggctcttgaagacgggataaacttcgcaacagggaatttgcccggttgctccttttctatcttcctccttgctctgttctcttgcttaatccatccagcagccagtttagagtggaggaacacgtctggtctctatgtcctcactaacgactgttccaatagcagcattgtgtatgaggccgatgacgttatcctgcacacacccggctgtataccttgtgttcaggacggcaatgcatctacgtgctggaccccagtgacacctacagtggcagtcaggtacgtcggagcaaccaccgcttcgatacgcagtcacgtggacctattagtgggcgcggccacgatgtgctctgcgctctacgtaggtgatatgtgtggggccgtcttcctcgtgggacaagccttcacgttcagacctcgtcgccatcagacggtccagacctgcaactgctcgctgtacccaggccatctttcaggacaccgaatggcttgggatatgatgatgaattggtcccccgctgtgggtatggtggtggcgcacatcctgcggttgccccagaccttgttcgacataatagccggagctcattggggcatcttggcgggcctggcctattactccatgcagggcaactgggccaaggtcgctatcatcatgattatgttttcgggggtcgatgccgacacacacaccattggtggtgtcgtagctcgtggagtcagaggactttcttctttgctcagtccgggccccaagcagaaactggagctgatcaacaccaacggatcgtggcacatcaatagtactgccctgaactgcaatgattccctaaacaccgggttcatagccgggctgatctattatcataagtttaactccactggatgtcctcaaaggctcagcagctgcaagcccatcacttccttcgggcaggggtggggccccttggcagatgctaacatcaccggctcttctgatgacagaccgtactgctggcactacgcacctagaccttgtaacacagtctcggcatcaagtgtctgcggccctgtgtactgcttcacgccgtcaccggtggtcgtgggcactactgatgctaagggcgcgccaacctacacctggggtgcgaatgagtcagacgtgttcctgctggaatccctgcggcctcccagtggtcggtggtttgggtgcgtgtggatgaactccacgggatttgtcaagacgtgcggagcccctccttgtgatatctatgggggtggggaaaatccccggaataagtcagactccctccgctgccccaccgactgcttcaggaaacatcctgaggccacatacagccggtgtggcgcggggccctggttgacacctcggtgcatggtagactacccataccggctttggcattacccatgtacagtcaattttacattgttcaaggtgaggatgtttgtaggtgggtttgagcaccggttctccgccgcctgcaactggaccaggggggagcgctgcaatatcgaggatcgtgaccgcagcgaacaacaaccgctgctgcattcaacaactgagcttgctatactgccttgctctttcacgcccatgcctgcgttgtcaacaggtctgatacacctccaccaaaacatcgtggatgtccaatacctttatggcgttggatctggcatggtgggatgggcgttgaagtgggagttcgtagtcctcattttcctcctcctagcagacgcacgcgtgtgcgttgccctttggctgatgctgatgataacgcaagcggaagcagccctggagaaccttgtcacgctgaatgctgtcgctgctgctgggacacatggtatcggctggtacctggtagccttttgcgcagcgtggtacgtgcggggtaaacttgtcccgctagtgacctacagcctgacgggactttggtccctggcactactcgttctcctgctcccccaacgggcgtatgcttggtcgggtgaggacagcgctactctcggtgctggggtcttgatcctcttcggcttctttaccttatcaccttggtacaagcataggatcggccgcctcatgtggtggaaccagtacgccatatgcaggtgcgagtccgcccttcaagtgtgggtcccccccctacttgcacgcgggagcagggacggtgtcatcctgctaacaagcctgctttatccatctttaatttttgacatcactaagctgctgatagcggtattgggcccattatacttgatacaggctgccatcactactaccccctattttgtgcgtgcgcatgtactggttcgcctttgcatgctcgtgcgctccatgatggggggaaaatacttccagatgatcatactgagcataggcaggtggttcaacacctacttatacgaccacctagcgccattgcaacactgggccgcagccggtctcaaagacctagcagtggccactgagcctgtaatattcagtcccatggaaatcaagatcatcacctggggcgcggacacagcagcttgtggagatattctttgcgggctgcccgtctctgcgcgattaggccgtgaggtattattgggacctgctgatgactatcgggagatgggttggcgcctgttggctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagcaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 89 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTVPASAYQVRNSSGLYHVTNDCPNSSIVYEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHITGHRMAWDMMMNWSPTAALVVAQLLRIPQAIMDMIAGAHWGVLAGIAYFSMVGNWAKVLVVLLLFAGVDAETHVTGGNAGRTTAGLVGLLTPGAKQNIQLINTNGSWHINSTALNCNESLNTGWLAGLFYQHKFNSSGCPERLASCRRLTDFAQGWGPISYANGSGLDERPYCWHYPPRPCGIVPAKSVCGPVYCFTPSPVVVGTTDRSGAPTYSWGANDTDVFVLNNTRPPLGNWFGCTWMNSTGFTKVCGAPPCVIGGVGNNTLLCPTDCFRKHPEATYSRCGSGPWITPRCMVDYPYRLWHYPCTINYTIFKVRMYVGGVEHRLEAACNWTRGERCDLEDRDRSELSPLLLSTTQWQVLPCSFTTLPALSTGLIHLHQNIVDVQYLYGVGSSIASWAIKWEYVVLLFLLLADARVCSCLWMMLLISQAEAALENLVILNAASLAGTHGLVSFLVFFCFAWYLKGRWVPGAVYALYGMWPLLLLLLALPQRAYALDTEVAASCGGVVLVGLMALTLSPYYKRYISWCMWWLQYFLTRVEAQLHVWVPPLNVRGGRDAVILLMCVVHPTLVFDITKLLLAIFGPLWILQASLLKVPYFVRVQGLLRICALARKIAGGHYVQMAIIKLGALTGTYVYNHLTPLRDWAHNGLRDLAVAVEPVVFSRMETKLITWGADTAACGDIINGLPVSARRGQEILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRLGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 90 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGNVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 91 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKGVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 92 - protein, 3029 aa, Hepatitis C virus
MSTNPKPQRKTKRNTNRRPQDVKFPGGGQIVGGVYLLPRRGPRLGVRATRKTSERSQPRGRRQPIPKARRPEGRTWAQPGYPWPLYGNEGCGWAGWLLSPRGSRPSWGPTDPRRRSRNLGKVIDTLTCGFADLMGYIPLVGAPLGGAARALAHGVRVLEDGVNYATGNLPGCSFSIFLLALLSCLTGPASAYQVRNSTGLYHVTNDCPNSSIVFEAADAILHTPGCVPCVREGNASRCWVAVTPTVATRDGKLPTTQLRRHIDLLVGSATLCSALYVGDLCGSVFLVGQLFTFSPRRHWTTQDCNCSIYPGHISGHRMAWDMMMNWSPTAALLVAQLLRIPQAILDMIAGAHWGVLAGMAYFSMVGNWAKVLVVLLLFAGVDAETYVTGGSAARTTAGLASLFSPGAKQNIQLVNTNGSWHINSTALNCNDSLNTGWIAGLFYHHKFNSSGCSERLASCRPLTDFAQGWGPISHADGSGPDQRPYCWHYPPKPCGIVPAKSVCGPVYCFTPSPVVVGTTDRSGAPTYSWGANDTDVFVLNNTRPPLGNWFGCTWMNSTGFTKVCGAPPCVIGGVGNNTLRCPTDCFRKHPEATYSRCGSGPWITPRCLVDYPYRLWHYPCTINYTVFKVRMYVGGVEHRLEAACNWTRGDRCNLDDRDRSELSPLLLSTTQWQVLPCSFTTLPALSTGLIHLHQNIVDVQYLYGVGSSIASWAIKWEYVVLLFLLLADARVCSCLWMMLLISQVEAALENLVVLNAASLAGTHGLVSFLVFFCFAWYLKGKWVPGAVYALYGMWPLLLLLLALPQRAYALDTEVAASCGGVVLVGLMALTLSPYYKRYISWCLWWLQYFLTRIEAQLHVWIPPLNVRGGRDAVILLMCVVHPALVFDITKLLLAAFGPLWILQASLLKVPYFVRVQGLLRICALARKMAGGHYVQMAIIKLGALTGTYVYNHLTPLRDWAHNGLRDLAVAVEPVVFSRMETKLITWGADTAACGDIINGLPVSARRGREILLGPADGMVSKGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGNVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKGVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 93 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKALAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 94 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPAPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 95 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHWIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKALAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKKKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPAPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

SEQ ID NO: 96 - protein, 3036 aa, Hepatitis C virus
MSTLPKPQRKTKRNTIRRPQDVKFPGGGQIVGGVYVLPRRGPRLGVRATRKTSERSQPRGRRQPIPKARRSEGRSWAQPGYPWPLYGNEGCGWAGWLLSPRGSRPSWGPNDPRRRSRNLGKVIDTLTCGFADLMGYIPLVGAPVGGVARALAHGVRALEDGINFATGNLPGCSFSIFLLALFSCLIHPAASLEWRNTSGLYVLTNDCSNSSIVYEADDVILHTPGCIPCVQDGNASTCWTPVTPTVAVRYVGATTASIRSHVDLLVGAATMCSALYVGDMCGAVFLVGQAFTFRPRRHQTVQTCNCSLYPGHLSGHRMAWDMMMNWSPAVGMVVAHILRLPQTLFDIIAGAHWGILAGLAYYSMQGNWAKVAIIMIMFSGVDADTHTIGGVVARGVRGLSSLLSPGPKQKLELINTNGSWHINSTALNCNDSLNTGFIAGLIYYHKFNSTGCPQRLSSCKPITSFGQGWGPLADANITGSSDDRPYCWHYAPRPCNTVSASSVCGPVYCFTPSPVVVGTTDAKGAPTYTWGANESDVFLLESLRPPSGRWFGCVWMNSTGFVKTCGAPPCDIYGGGENPRNKSDSLRCPTDCFRKHPEATYSRCGAGPWLTPRCMVDYPYRLWHYPCTVNFTLFKVRMFVGGFEHRFSAACNWTRGERCNIEDRDRSEQQPLLHSTTELAILPCSFTPMPALSTGLIHLHQNIVDVQYLYGVGSGMVGWALKWEFVVLIFLLLADARVCVALWLMLMITQAEAALENLVTLNAVAAAGTHGIGWYLVAFCAAWYVRGKLVPLVTYSLTGLWSLALLVLLLPQRAYAWSGEDSATLGAGVLILFGFFTLSPWYKHRIGRLMWWNQYAICRCESALQVWVPPLLARGSRDGVILLTSLLYPSLIFDITKLLIAVLGPLYLIQAAITTTPYFVRAHVLVRLCMLVRSMMGGKYFQMIILSIGRWFNTYLYDHLAPLQHWAAAGLKDLAVATEPVIFSPMEIKIITWGADTAACGDILCGLPVSARLGREVLLGPADDYREMGWRLLAPITAYAQQTRGLLGAIVVSMTGRDRTEQAGEVQILSTVSQSFLGTTISGVLWTVYHGAGNKTLAGLRGPVTQMYSSAEGDLVGWPSPPGTKSLEPCKCGAVDLYLVTRNADVIPARRRGDKRGALLSPRPISTLKGSSGGPVLCPRGHVVGLFRAAVCSRGVAKSIDFIPVETLDVVTRSPTFSDNSTPPAVPQTYQVGYLHAPTGSGKSTKVPVAYAAQGYKVLVLNPSVAATLGFGAYLSKAHGINPNIRTGVRTVMTGEAITYSTYGKFLADGGCASGAYDIIICDECHAVDATSILGIGTVLDQAETAGVRLTVLATATPPGSVTTPHPDIEEVGLGREGEIPFYGRAIPLSCIKGGRHLIFCHSKQKCDELAAALRGMGLNAVAYYRGLDVSIIPAQGDVVVVATDALMTGYTGDFDSVIDCNVAVTQAVDFSLDPTFTITTQTVPQDAVSRSQRRGRTGRGRQGTYRYVSTGERASGMFDSVVLCECYDAGAAWYDLTPAETTVRLRAYFNTPGLPVCQDHLEFWEAVFTGLTHIDAHFLSQTKQAGENFAYLVAYQATVCARAKAPPPSWDAMWKCLARLKPTLAGPTPLLYRLGPITNEVTLTHPGTKYIATCMQADLEVMTSTWVLAGGVLAAVAAYCLATGCVSIIGRLHVNQRVVVAPDKEVLYEAFDEMEECASRAALIEEGQRIAEMLKSKIQGLLQQASKQAQDIQPAMQASWPKVEQFWARHMWNFISGIQYLAGLSTLPGNPAVASMMAFSAALTSPLSTSTTILLNIMGGWLASQIAPPAGATGFVVSGLVGAAVGSIGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPIPCSGSWLRDVWDWVCTILTDFKNWLTSKLFPKLPGLPFISCQKGYKGVWAGTGIMTTRCPCGANISGNVRLGSMRITGPKTCMNTWQGTFPINCYTEGQCAPKPPTNYKTAIWRVAASEYAEVTQHGSYSYVTGLTTDNLKIPCQLPSPEFFSWVDGVQIHRFAPTPKPFFRDEVSFCVGLNSYAVGSQLPCEPEPDADVLRSMLTDPPHITAETAARRLARGSPPSEASSSVSQLSAPSLRATCTTHSNTYDVDMVDANLLMEGGVAQTEPESRVPVLDFLEPMAEEESDLEPSIPSECMLPRSGFPRALPAWARPDYNPPLVESWRRPDYQPPTVAGCALPPPKKAPTPPPRRRRTVGLSESTISEALQQLAIKTFGQPPSSGDAGSSTGAGAAESGGPTSPGEPAPSETGSASSMPPLEGEPGDPDLESDQVELQPPPQGGGVAPGSGSGSWSTCSEEDDTTVCCSMSYSWTGALITPCSPEEEKLPINPLSNSLLRYHNKVYCTTSKSASQRAKKVTFDRTQVLDAHYDSVLKDIKLAASKVSARLLTLEEACQLTPPHSARSKYGFGAKEVRSLSGRAVNHIKSVWKDLLEDPQTPIPTTIMAKNEVFCVDPAKGGKKPARLIVYPDLGVRVCEKMALYDITQKLPQAVMGASYGFQYSPAQRVEYLLKAWAEKKDPMGFSYDTRCFDSTVTERDIRTEESIYQACSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGRRRYYLTRDPTTPLARAAWETVRHSPINSWLGNIIQYAPTIWVRMVLMTHFFSILMVQDTLDQNLNFEMYGSVYSVNPLDLPAIIERLHGLDAFSMHTYSHHELTRVASALRKLGAPPLRVWKSRARAVRASLISRGGKAAVCGRYLFNWAVKTKLKLTPLPEARLLDLSSWFTVGAGGGDIFHSVSRARPRSLLFGLLLLFVGVGLFLLPAR

The invention claimed is:

1. An isolated nucleic acid molecule comprising a nucleic acid sequence which encodes a genetically engineered human hepatitis C virus of genotype 1b/2a wherein the genotype 2a is strain JFH-1 and wherein said molecule:
   (i) is capable of expressing said virus when transfected into cells, and
   (ii) the nucleic acid sequence encodes an amino acid sequence with a sequence identity of at least 92% to that of SEQ ID NO: 4 which comprises at least one adaptive mutation in the amino acid sequence of NS2 or NS3 selected from the group consisting of F886L, I1312V, K1398Q, R1408W, and Q1496L.

2. The isolated nucleic acid molecule according to claim 1, wherein the at least one adaptive mutation is selected from the group consisting of F886L and Q1496L.

3. The isolated nucleic acid molecule according to claim 1, wherein said isolated nucleic acid molecule is further capable of infectivity in vivo.

4. A hepatitis C virus particle comprising a nucleic acid molecule, wherein said nucleic acid molecule comprises a nucleic acid sequence that encodes a genetically engineered genotype 1b/2a hepatitis C virus, wherein the genotype 2a is strain JFH-1, and wherein the nucleic acid sequence has at least 92% of sequence identity to SEQ ID NO: 3 and at least one adaptive mutation in the nucleic acid sequence encoding NS2 or NS3 selected from the group consisting of T2996C, A4274G, A4532C, C4562T, and A4827T.

5. The hepatitis C virus of claim 4, wherein the at least one adaptive mutation in said nucleic acid sequence is selected from the group consisting of T2996C and A4827T.

6. The isolated nucleic acid of claim 1, wherein said nucleic acid is selected from the group consisting of double stranded DNA, complementary DNA (cDNA), positive-sense cDNA, negative-sense cDNA, positive-sense RNA, negative-sense RNA, and double stranded RNA.

7. The isolated nucleic acid molecule of claim 1, wherein said nucleic acid sequence encodes the adaptive mutations F886L in NS2 and Q1496L in NS3.

8. The hepatitis C virus of claim 5, wherein said nucleic acid molecule comprises the adaptive mutations T2996C in the nucleic acid sequence encoding NS2 and C4827T in the nucleic acid sequence encoding NS3.

9. The isolated nucleic acid molecule of claim 1, wherein said nucleic acid molecule comprises:
   (i) the Core, E1, E2, p7 and NS2 genes of HCV genotype 1b; and,
   (ii) the NS3, NS4A, NS4B, NS5A, and NS5B genes from the HCV JFH1 strain.

10. The hepatitis C virus particle of claim 4, wherein said nucleic acid molecule comprises:
   (i) the Core, E1, E2, p7 and NS2 genes of HCV genotype 1b; and,
   (ii) the NS3, NS4A, NS4B, NS5A and NS5B genes from the HCV JFH1 strain.

* * * * *